(12) United States Patent
Kottwitz et al.

(10) Patent No.: US 9,957,575 B2
(45) Date of Patent: May 1, 2018

(54) METHODS FOR DETECTING CPG METHYLATION AND FOR DIAGNOSING CANCER

(71) Applicant: EPIGENOMICS AG, Berlin (DE)

(72) Inventors: Denise Kottwitz, Berlin (DE); Jörn Lewin, Berlin (DE); Anne Schlegel, Berlin (DE); Reimo Tetzner, Berlin (DE)

(73) Assignee: EPIGENOMICS AG, Berlin (DE)

( * ) Notice: Subject to any disclaimer, the term of this patent is extended or adjusted under 35 U.S.C. 154(b) by 0 days. days.

(21) Appl. No.: 15/436,436

(22) Filed: Feb. 17, 2017

(65) Prior Publication Data

US 2017/0233820 A1    Aug. 17, 2017

Related U.S. Application Data

(63) Continuation of application No. PCT/EP2015/080549, filed on Dec. 18, 2015.

(30) Foreign Application Priority Data

Dec. 19, 2014 (EP) .................................... 14199447

(51) Int. Cl.
*C12Q 1/68* (2006.01)
*C12P 19/34* (2006.01)

(52) U.S. Cl.
CPC ......... *C12Q 1/6886* (2013.01); *C12Q 1/6848* (2013.01); *C12Q 1/6858* (2013.01); *C12Q 2600/154* (2013.01); *C12Q 2600/156* (2013.01); *C12Q 2600/158* (2013.01)

(58) Field of Classification Search
None
See application file for complete search history.

(56) References Cited

FOREIGN PATENT DOCUMENTS

EP    1 394 172 A1    3/2004

OTHER PUBLICATIONS

Dietrich (Int. J. Oncology, 2012, 40:825-832).*
Schneider (BMC Cancer, 2011, 11: 102, pp. 1-9).*
Clark et al. (1994) Nucleic Acids Research. 22(15):2990-2997.
Cottrell et al. (2004) "A real-time PCR assay for DNA-methylation using methylation-specific blockers," Nucleic Acids Research. 32(1):e10. pp. 1-8.
Eads et al. (1999) "CpG island hypermethylation in human colorectal tumors is not associated with DNA methyltransferase overexpression," Cancer Res. 59:2302-2306.
Fleischhacker et al. (2007) "Circulating nucleic acids (CNAs) and cancer—a survey," Biochim. Biophys. Acta. 1775:181-232.
Frommer et al. (1992) "A genomic sequencing protocol that yields a positive display of 5-methylcytosine residues in individual DNA strands," Proc. Natl. Acad. Sci. USA. 89:1827-1831.
Gibney et al. (2010) "Epigenetics and gene expression," Heredity. 105: 4-13.
Jung et al. (2010) "Cell-free DNA in the blood as a solid tumor biomarker—a critical appraisal of the literature," Clin. Chim. Acta. 411:1611-1624.
Mandel et al. (1948) "Les acides nucleiques du plasma sanguin chez l'homme," C. R. Seances Soc. Biol. Fil. 142 (3-4):241-243.—with English machine translation.
Ogino et al. (2006) "Precision and Performance Characteristics of Bisulfite Conversion and Real-Time PCR (MethyLight) for Quantitative DNA Methylation Analysis," J. Mol. Diagn. 8(2):209-217.
Olek et al. (1996) "A modified and improved method for bisulphite based cytosine methylation analysis," Nucleic Acids Res. 24:5064-5066.
Rago et al. (2007) "Serial assessment of human tumor burdens in mice by the analysis of circulating DNA," Cancer Res. 67:9364-9370.
Rand et al. (Sep. 10, 2012) Nucleic Acids Research. 41(1):e15.
Smith et al. (2013) "DNA methylation: roles in mammalian development," Nat. Rev. Genet. 14:204-220.
Suva et al. (2013) "Epigenetic reprogramming in cancer," Science 339:1567-1570.
Tetzner (2006) "Entwicklung von Realtime-PCR-Methoden zur Analyse von DNA-Methylierung," Dissertation for fulfillment of the requirements of Doctor of Natural Sciences. University of Saarlandes.—English summary only on pp. 7-8, 120 pgs.
International Search Report with Written Opinion corresponding to International Patent Application No. PCT/EP2015/080549, dated Mar. 4, 2016.
International Preliminary Report on Patentability corresponding to International Patent Application No. PCT/EP2015/080549, dated Jun. 20, 2017.

* cited by examiner

*Primary Examiner* — Sarae L Bausch
(74) *Attorney, Agent, or Firm* — Lathrop Gage LLP; James H. Velema, Esq.; Sean M. Coughlin, Esq.

(57) ABSTRACT

The present invention relates to the field of pharmacogenomics and in particular to detecting the presence or absence of hypermethylated DNA. The detection of CpG methylation in marker DNA is useful for the diagnosis of cancers and the invention provides improved methods for this purpose. These improved methods allow in particular for a more sensitive detection of methylated marker DNA with high backgrounds of unmethylated marker DNA.

14 Claims, 11 Drawing Sheets

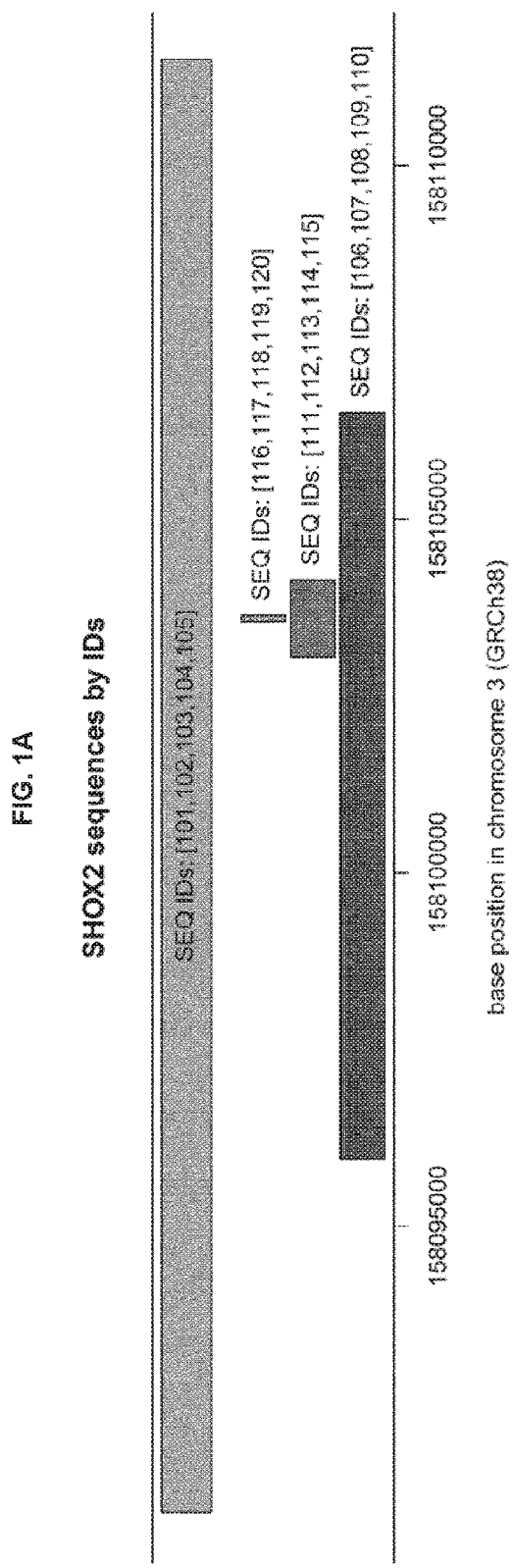

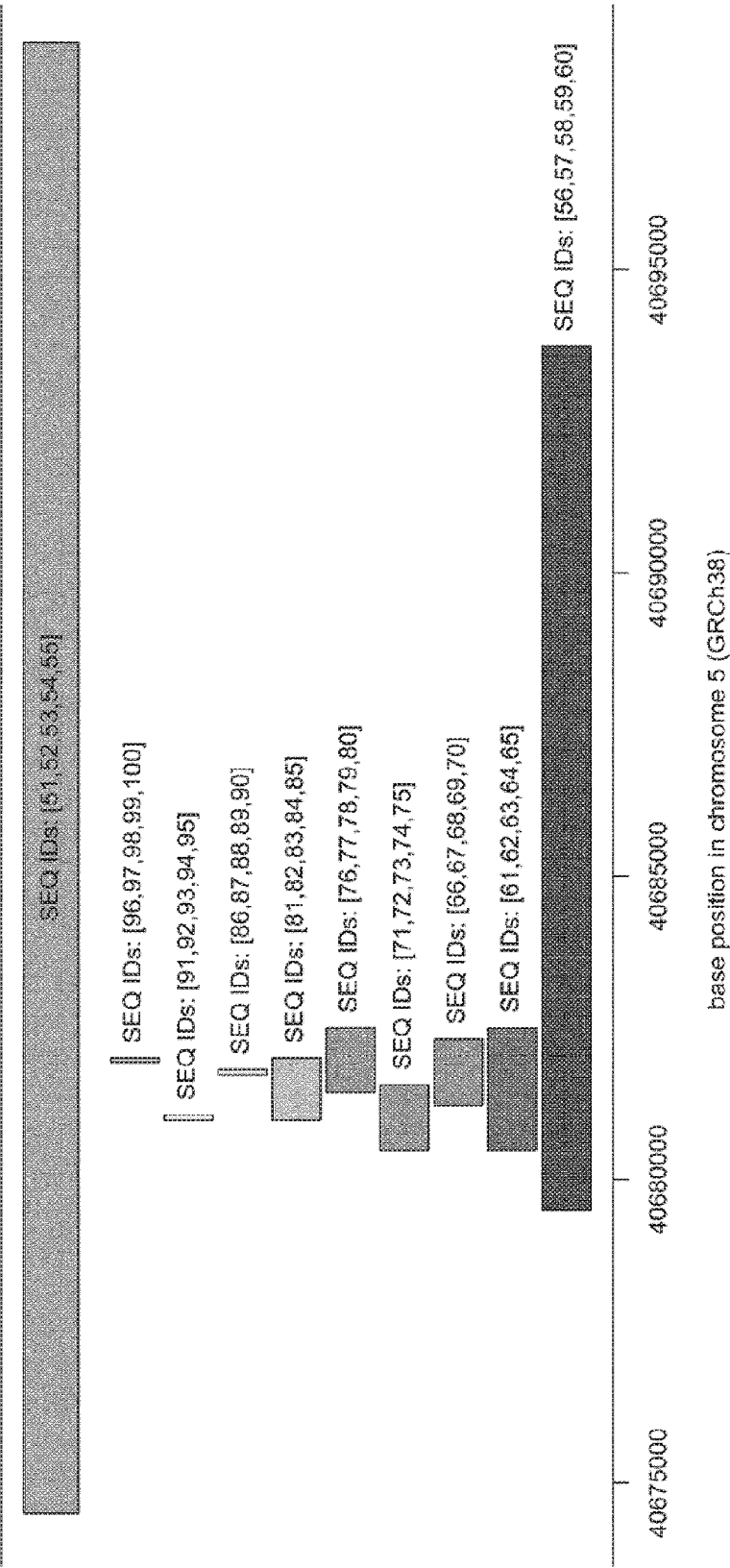

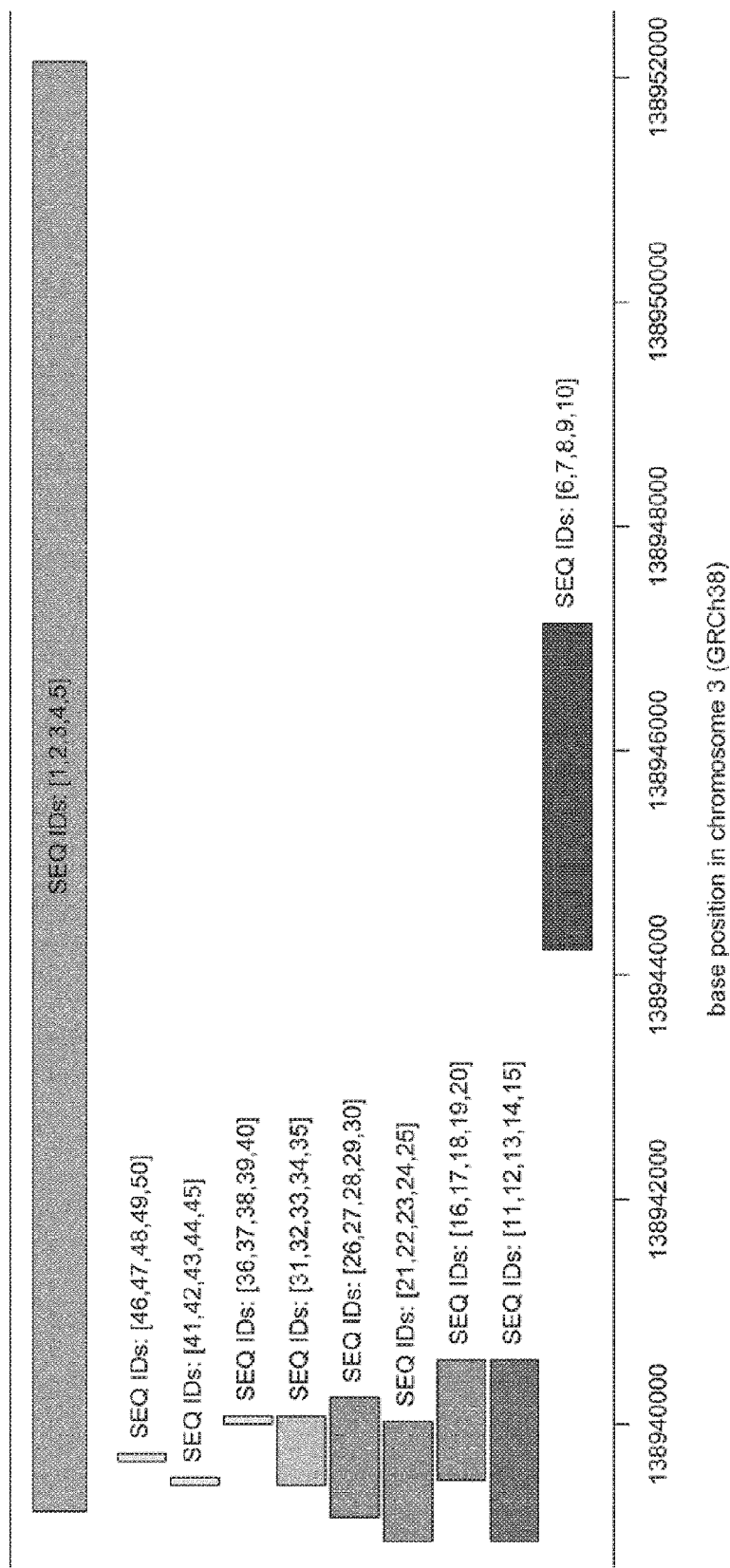

FIG. 2

FOXL2 assay based on the genomic reference SEQ ID NO: 46
SEQ ID NO:128 5' tacaacRccRccaacaaacccRaaacacaca 3' blocker SEQ ID NO:126
                                                                                         -->
5' ccaaaaacctaaacttacaacRccRcCAACAAACCRAAAACAORAAACRCTCCAAACCRAAATCTTCC 3' synth.
5' ccaacacctgaacctRacaacRccRccaacaaacccRaaacacacaRcccRcccccRcRtcc 3' genomic
3' GGTTCTGGACCCGAACGTCCGGCGGTTGTCCGGGCCCCTGTGCCGAGGTCCGGCCCCCAGAAGG 5' genomic
3' ggttttggatttgaattgttggRcgttgttttgggRtttcgtRtttgRgaggt.tttggRtttagaaagg 5' bis
                          3' tggqRtttgtgRttgR 5' (reverse)
                  SEQ ID NO:129 (5' RgttRtgttttRggqt 3' probe)

PTGER4 assay based on the genomic reference SEQ ID NO: 91
         SEQ ID NO:147 5' RgttttttgagttRgatRg 3' probe SEQ ID NO: 144 -->
5' gttagttattattatgtttattttRggggttaattRgttRgttttttgagtttRgatYRggttgaatagttagtgatzatt 3' bis.
5' GCCAGCCACTATCATGTCCACTCCCGGGGTCAATTGTCCGCTCCTTGAGCCCGACGGCTGAACAGCCCAGTGACCATCC 3' genomic
5' GGCTGGGTGAGTAGCAGTCAGGGGGGAGTTAAGAAGGCGAACTCGGGGGCGAGTTCTGGGGTGACTGCTACG 5' genomic
3' CAATCAATAATATACAAATAAARCCCCAATTAARCAPARCAAAAAACTCAAARCTARCCAACTTATCAAATCACTAATAAA 5' synth.
                                                            <-- SEQ ID NO: 145 --
                                     3' Rcaa Rcaaaaaactcaaa Rcta Rccaactt 5' (reverse)
                SEQ ID NO: 146 (5' ttcaaccRatcRaaaccRaaaaaaacRaaacR 3' blocker)

SHOX2 assay based on the genomic reference SEQ ID NO: 116
SEQ ID NO:123 5' ggtaatttRgttRgtttgttRgatRgggt 3' blocker SEQ ID NO:121 -->
5' gttttttgatagtagtaattttRgtttgttRgatRgggtRgatRggggtRgtaRgagtataggRgttaRgttatgttggtRgtttaaaggcg 3' bis.
5' GTCCCCTGACAGCCAGGTAATCTCCGTCCCCGCCCTGGCCGCCGCCCCAGGCGCCACGAGCACAGGCGCCATGTTGGCTGCCCAAGG 3' genomic
5' CAGGGGACGTGTCGCATTAGAGGCAGCCCGGCGCCGCCGTCTGTGTCCCGCGTGGTCGCGAACGCGGCTTGCG 5' genomic
3' CAAAAAACTTATCATCAATCCATTAAAARCAAARCAAACAARCAARCTARCCCARCATRCTCATATCCRCAAATRCaatacaaccaRcaaatttccR 5' synth.
                                                        <-- SEQ ID NO:122 --
                        3' RctaRcccaRcaRctc 5' (reverse)
               SEQ ID NO:125 (5' ctcgtacgaccccgatcg 3' probe)

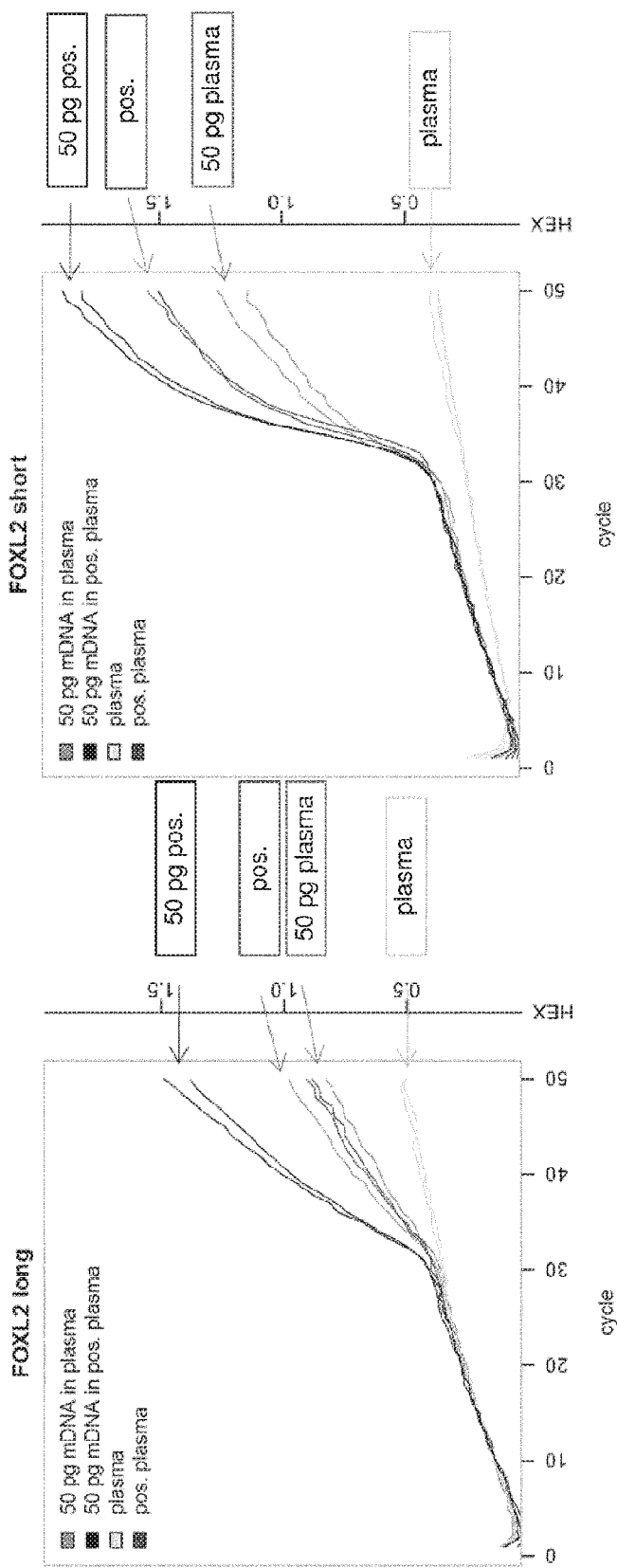

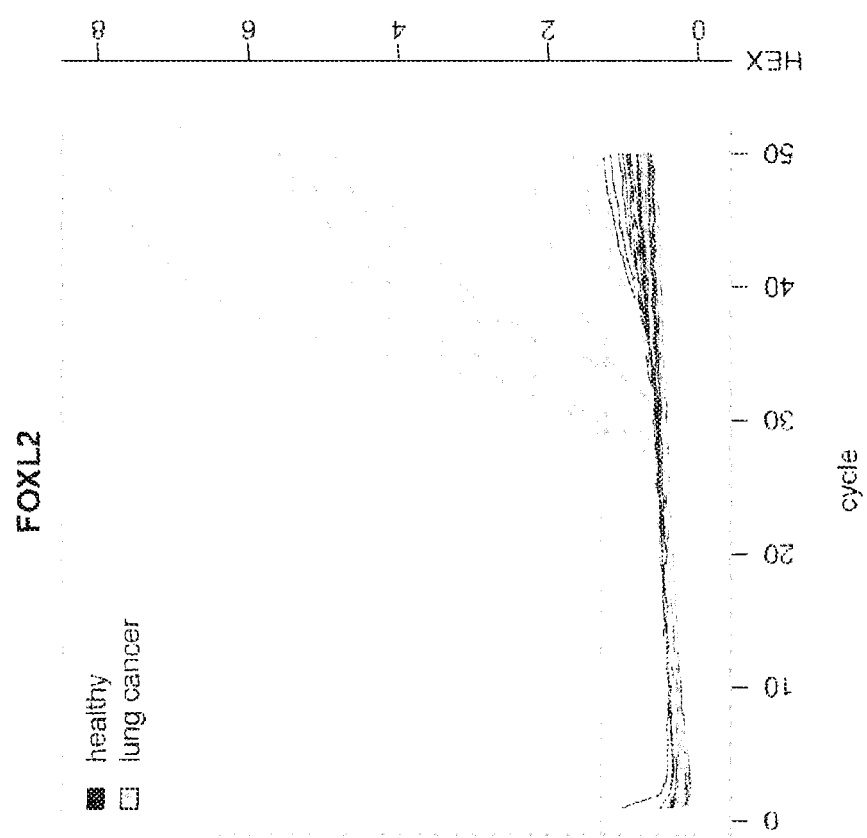

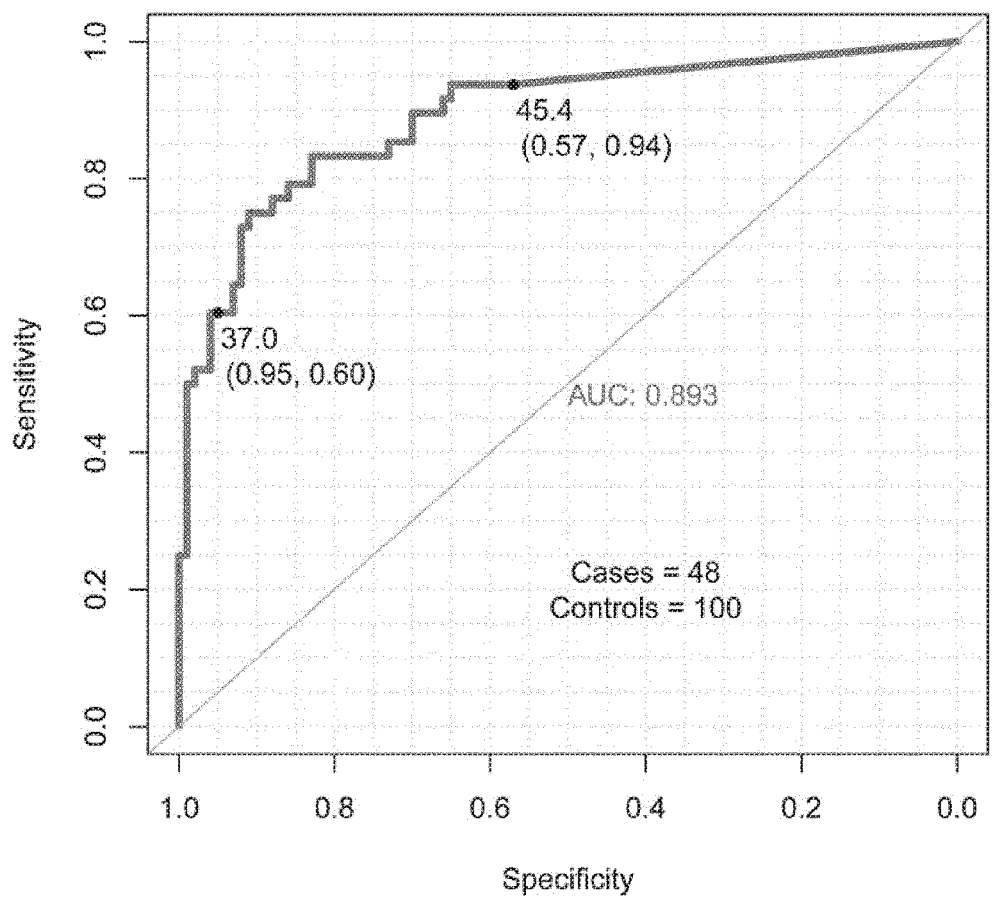

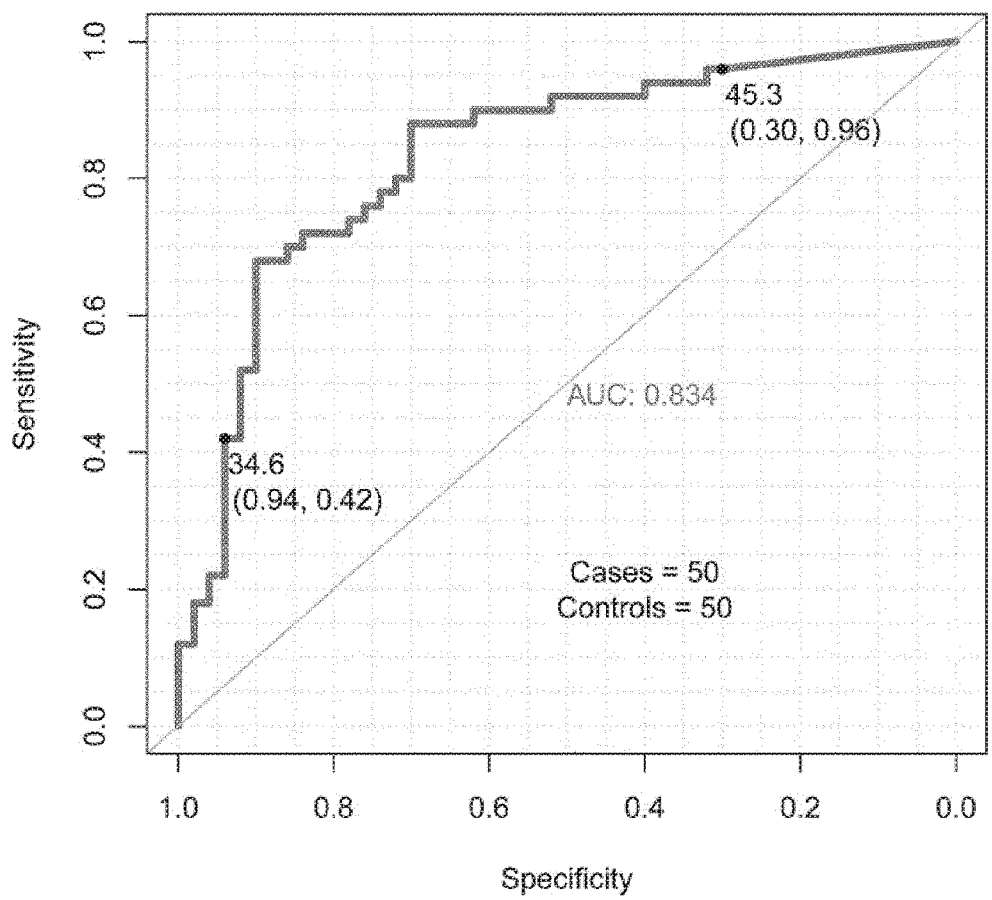

METHODS FOR DETECTING CPG METHYLATION AND FOR DIAGNOSING CANCER

RELATED APPLICATIONS

This application claims the benefit of International Patent Application No. PCT/EP2015/080549, filed Dec. 18, 2015, and European Patent Application No. 14199447.5, filed Dec. 19, 2014, the entire disclosures of which are hereby incorporated herein by reference.

FIELD OF THE INVENTION

The present invention relates to the field of pharmacogenomics and in particular to detecting the presence or absence of hypermethylated DNA. The detection of CpG methylation in marker DNA is useful for the diagnosis of cancers and cancer subtypes and the invention provides improved methods for this purpose. These improved methods allow in particular for a more sensitive detection of methylated marker DNA with high backgrounds of unmethylated marker DNA.

BACKGROUND OF THE INVENTION

More than 65 years ago Mandel and Metais described for the first time their observation of the presence of extracellular nucleic acids in humans (Mandel P, Metais P. Les acides nucleiques du plasma sanguin chez l'homme. C. R. Acad. Sci. Paris 142, 241-243. 1948) and more than four decades later it could be clearly demonstrated that tumor-associated genetic alterations can be found in cell-free nucleic acids isolated from plasma, serum and other body fluids (Fleischhacker M, Schmidt B. (2007) Circulating nucleic acids (CNAs) and cancer—a survey. Biochim Biophys Acta 1775: 181-232; Jung K, Fleischhacker M, Rabien A. (2010) Cell-free DNA in the blood as a solid tumor biomarker—a critical appraisal of the literature. Clin Chim Acta 411: 1611-1624). This includes epigenetic alterations observed in different forms of malignant tumors. A hallmark of mammalian chromatin is DNA methylation and it is known that cytosine methylation in the context of a CpG dinucleotide plays a role in the regulation of development and is important in basic biological processes like embryogenesis and cell differentiation (Smith Z D, Meissner A. (2013) DNA methylation: roles in mammalian development. Nat Rev Genet 14: 204-220; Gibney E R, Nolan C M. (2010) Epigenetics and gene expression. Heredity (Edinb) 105: 4-13). As such, methylation not only regulates gene transcription, but also plays a role in maintaining genome stability, imprinting and X-chromosome inactivation. Epigenetic alterations in oncogenes and tumor suppressor genes are of key importance in the development of cancer (Suva M L, Riggi N, Bernstein B E. (2013) Epigenetic reprogramming in cancer. Science 339: 1567-1570). DNA methylation patterns are largely modified in cancer cells and can therefore be used to distinguish cancer cells from normal tissues. As such, DNA methylation patterns are being used to diagnose all sorts of cancers. A relatively recent concept is the use of free circulating tumor DNA that is released from the tumor for example into the blood for methylation analysis as an indicator for tumor load in the body of the patient. This ability to isolate and to characterize extracellular nucleic acids from tumor patients with very sensitive and highly specific methods led to the term "liquid biopsy". As a result, physicians no longer depend exclusively on a single examination of tissue biopsies and body scans. The detection of small amounts of methylated tumor DNA with high backgrounds of unmethylated non-tumor DNA in such a liquid biopsy greatly challenges the sensitivity of the detection methods. Very good results have been achieved using technologies based on a selective amplification of methylated tumor DNA after bisulfite conversion, like methylation-specific PCR (MSP) and especially the HeavyMethyl™ (HM) technology (Cottrell et al., A real-time PCR assay for DNA-methylation using methylation-specific blockers. Nucleic Acids Res. 2004 Jan. 13; 32(1):e10).

The less advanced the cancer is, the better the treatment options and the chances of curing the patient are. Thus, it is highly desirable to diagnose a cancer as early as possible. However, a less advanced cancer, which means smaller tumor size and less cancer cells, releases less free circulating tumor DNA. This is exacerbated by the fact that the half-life of extracellular nucleic acids is rather short, for example less than six hours in plasma (Rago C, Huso D L, Diehl F, Karim B, Liu G, et al. (2007) Serial assessment of human tumor burdens in mice by the analysis of circulating DNA. Cancer Res 67: 9364-9370). Therefore, the more sensitive a detection method is, the earlier the cancer can be reliably diagnosed or diagnosed at all. Accordingly, there is a need in the art for methods of detecting DNA methylation with an increased sensitivity.

For sensitive detection, HeavyMethyl™ or HM (primers bind methylation unspecifically but are blocked methylation specifically and therefore will be re-blocked even if unwanted template is produced at minimal levels when blocking failed in previous amplification cycles) is regarded as first choice when compared to MSP (which primes methylation specifically and therefore introduces perfect match template in case that mispriming happens which will then exponentially be amplified). The advantages of HM seemed to be a tradeoff with one disadvantage: The widely accepted theory was that CpG rich parts for the blockers need to be side by side with priming sites without CpGs. This greatly limits the choice of the site or region to be analysed, because there are only so many suitable sites or regions in a given target DNA.

Due to design constrictions (undesired CpG sites, SNPs etc.), methylation assays in the past used amplicons with sizes up to 150 bp for HM, which the inventors thought to be generally applicable also to address the fragmentation of DNA in circulating tumor DNA. Years of experience and comparison of results showed the inventors that cancer marker assays with such length were very useful in specimen containing cancer cells (full size high molecular weight genomic tumor DNA), and also useful (although with a somewhat reduced sensitivity) when applied to liquid biopsies/body fluids, in which the target is free circulating DNA (such DNA is expected to be at least partially fragmented).

The inventors have now found that, surprisingly, a further decrease in the size of the amplificate leads to a much better amplification (even independent of DNA fragmentation as found in circulating tumor DNA), giving a significantly improved signal which is especially useful when the original template, i.e. the methylated tumor DNA, is scarce among a high background of unmethylated non-tumor DNA. The reduction of the amplicon size as a primary design goal overruling other concerns (such as undesired CpG sites, SNPs etc.) has, to the inventors knowledge, not been done before since a small size greatly limits the choice of sites or regions to be analysed: there are much fewer suitable sites or regions because of the presence of CpG sites which would be covered by the primers, which must be methylation-unspecific for a sensitive detection using HeavyMethyl™. Also, SNP sites should not be covered by the primers, since it biases sensitivity if the primers are specific for a particular nucleotide of the SNP.

The inventors also found, surprisingly, that the introduction of mismatches in CpG sites (or SNP sites) in the primers for HM (methylation unspecific by introducing e.g. C=C, T=C, C=T or T=T mismatches with the first base in the primer and the second in the bisulfite DNA sense template—or A=G, G=G, A=A or G=A mismatches—with the first base in the primer and the second in the bisulfite synthetized reverse complement strand—for cytosine positions in CpG sites) did not introduce worse blocking or unspecific priming even if a mismatch position was located in the middle of the primer (and not limited to positions next to the 5' end of a primer were one would expect little negative influence), not only when the overall primer binding enthalpy was adjusted by design (e.g. extension). In fact, there was evidence that such constructs might even be blocked better. The inventors believe that this might be due to the instability of blocked primers being even higher compared to unblocked primers still being well annealed.

Methods for detecting cancer which are adapted according to these findings will allow for an improved care for cancer patients by providing the possibility of the most promising time window for treatment.

SUMMARY OF THE INVENTION

In a first aspect, the present invention relates to a method for detecting the presence or absence of hypermethylated target DNA in a sample comprising genomic DNA.

In a first basic embodiment thereof, it relates to a method for detecting the presence or absence of hypermethylated target DNA in a sample comprising genomic DNA, wherein said genomic DNA is at least partially fragmented, comprising the steps:
(a) converting, in the DNA, cytosine unmethylated in the 5-position to uracil or another base that does not hybridize to guanine;
(b) amplifying a region of the converted target DNA using methylation-unspecific primer oligonucleotides and at least one methylation-specific blocker blocking the amplification in a methylation-specific manner, wherein said region is less than 100 basepairs (bp) long and comprises at least 3 CpG sites of the genomic DNA; and
(c) detecting the presence or absence of DNA amplified in step (b),
wherein the presence or absence of amplified DNA reflects the presence or absence, respectively, of hypermethylated target DNA in the sample.

In a second basic embodiment thereof, it relates to a method for detecting the presence or absence of hypermethylated target DNA in a sample comprising genomic DNA, comprising the steps:
(a) converting, in the DNA, cytosine unmethylated in the 5-position to uracil or another base that does not hybridize to guanine;
(b) amplifying a region of the converted target DNA using methylation-unspecific primer oligonucleotides and at least one methylation-specific blocker blocking the amplification in a methylation-specific manner, wherein at least one primer oligonucleotide covers (1) at least one CpG site with a methylation-unspecific mismatch or a spacer regarding the cytosine base position of the CpG site and/or (2) at least one SNP site with an SNP-unspecific mismatch or a spacer; and
(c) detecting the presence or absence of DNA amplified in step (b);
wherein the presence or absence of amplified DNA reflects the presence or absence, respectively, of hypermethylated target DNA in the sample.

In a second aspect, the present invention relates to a method for detecting the presence or absence of cancer in a subject, comprising the method for detecting the presence or absence of hypermethylated target DNA in a sample comprising genomic DNA according to the first aspect, wherein
said sample is a subject-derived sample comprising, in a subject having said cancer, tumor DNA of a cancer cell,
said target DNA is hypermethylated in cancer cells of a patient having said cancer, and
the presence or absence of hypermethylated target DNA in the sample is indicative for the presence or absence, respectively, of the cancer in the subject.

In a third aspect, the present invention relates to a methylation-unspecific primer oligonucleotide suitable, together with another primer oligonucleotide, for generating an amplificate from a single strand of genomic DNA in which cytosine unmethylated in the 5-position has been converted to uracil or another base that does not hybridize to guanine, wherein the at least one primer oligonucleotide covers at least one CpG site with a methylation-unspecific mismatch or a spacer regarding the cytosine base position of the CpG site.

In a fourth aspect, the present invention relates to a kit suitable for performing the method of the first aspect.

In a first basic embodiment thereof, it relates to a kit comprising
(i) at least one pair of methylation-unspecific primer oligonucleotides consisting of a forward and a reverse primer, wherein said pair of primers is suitable for generating an amplificate from a single strand of genomic DNA in which cytosine unmethylated in the 5-position has been converted to uracil or another base that does not hybridize to guanine, wherein said genomic DNA is at least partially fragmented, and wherein said amplificate is less than 100 bp long and comprises at least 3 CpG sites of the genomic DNA; and
(ii) at least one methylation-specific blocker capable of blocking the amplification in a methylation-specific manner.

In a second basic embodiment thereof, it relates to a kit comprising
(i) at least one pair of methylation-unspecific primer oligonucleotides consisting of a forward and a reverse primer, wherein said pair of primers is suitable for generating an amplificate from a single strand of genomic DNA in which cytosine unmethylated in the 5-position has been converted to uracil or another base that does not hybridize to guanine, wherein said amplificate comprises at least 3 CpG sites of the genomic DNA in the region between the binding sites of the primers, and wherein at least one primer oligonucleotides covers (1) at least one CpG site with a methylation-unspecific mismatch or a spacer regarding the cytosine base position of the CpG site and/or (2) at least one SNP site with an SNP-unspecific mismatch or a spacer; and
(ii) at least one methylation-specific blocker capable of blocking the amplification in a methylation-specific manner.

In a fifth aspect, the present invention relates to the use of the methylation-unspecific primer oligonucleotide of the third aspect or the kit of the fourth aspect for detecting the presence or absence of cancer in a subject.

BRIEF DESCRIPTION OF THE DRAWINGS

FIGS. 1A-1C: Map of preferred target regions. FIG. 1A: SHOX2, FIG. 1B: PTGer4, FIG. 1C: FOXL2. See Table 1 for an explanation of the SEQ ID NOs.

FIG. 2: Assay examples. Reference and assay DNA sequences are in the sense orientation of the GRCh38 genome build. Assays and their elements are aligned with the genomic reference sequence (genomic, both strands shown) in the middle. Thereby the strand that is not crossed out provides the bisulfite converted strand that is relevant as template for the assay. The crossed out reverse complement genomic strand is irrelevant for the assay but is shown for the sake of completeness. On top and bottom of the genomic reference sequence two derived sequences are shown: the bisulfite strand which is the initial template for amplification (bis.) and its reverse complement strand that is unavailable until it is synthesized by amplification (synth). Which of these sequences is on top or bottom is dependent on the sequence orientation in the genome build. All DNA single strand sequences are annotated with 3' and 5' on both ends according to their orientation. The nomenclature uses IUPAC bases: Y means either C or T (depending on the unknown methylation state of a cytosine in CpG context), R means either G or A (base reverse complement of a cytosine in CpG position of which the methylation state is unknown). Primer sequences are shown by underlined sequences. Other oligomers like blockers and probes are shown in alignment with the assay and reference sequences—in cases where the reverse sequence is needed (match on the reverse strand of the assay) it is shown in addition and in grey text color. Cytosine in CpG context, their counterparts on the opposite strand and/or any base in probe or blocker interrogating them indirectly or directly are shown as bold characters with grey background (e.g. ¥ or ë). Capital letters are used in different context: For all genomic reference sequences, for the bases of the synthesized strand reverse complement to the bisulfite template (excluding the primer) and for DNA-methylation measurement relevant positions in the bisulfite product. Bases in primer regions that are either cytosines in CpG context or SNPs—which are excluded from influencing the PCR by introducing mismatches in the primer for all possible states are highlighted by white font on black background (e.g. ¥). Thymidines in the bisulfite template strand that are derived from cytosines outside of CpG context (first by deamination to uracil, later be replacement with thymidine in PCR) are shown in italic (e.g. t).

FIG. 3A shows a graph of amounts of DNA amplified with a long FOXL2 assay. FIG. 3B shows a graph of amounts of DNA amplified with a short FOXL2 assay.

FIGS. 4A-4B: Comparison of a 90 bp realtime PCR assay for FOXL2 without a mismatch in the middle of a primer and a 68 bp for FOXL2 with a methylation unspecific mismatch in the middle one primer covering and assessing the very same CpGs with their blockers and probes using plasma samples negative (containing no methylated FOXL2) and slightly positive (containing methylated FOXL2 at the level of about 50 pg) for the marker unspiked and spiked with 50 pg of methylated DNA.

FIGS. 5A-5C: Performance of the 68 bp for FOXL2 with a methylation unspecific mismatch in the middle of one primer using technical samples (FIG. 5A), unspiked plasma and plasma spiked at different levels (FIG. 5B) and plasma samples from lung cancer and healthy patients (FIG. 5C). PCRs for technical samples and spiked plasma were done in triplicate. FIG. 5C shows a Cycle threshold (Ct) cutoff of 1.3 HEX signal at which curves were called for determining the Ct. At this cutoff only cancer patient could be assessed, signals from healthy patients were below the threshold.

FIG. 7: SHOX2 methylation in blood plasma samples from lung cancer patients in comparison to blood plasma controls from healthy individuals assessed by real time PCR in a triplex reaction with another methylation marker and ACTB as reference. 48 samples from lung cancer patients and 100 healthy controls were compared. Calculated AUC=0.893 (for SHOX2 assessed independent from the other rmethylation marker used). Marked points are thresholds for 95% sensitivity resp. 95% specificity.

FIG. 8: SHOX2 methylation in blood plasma from lung cancer patients in comparison to blood plasma controls having diverse lung diseases by real time PCR in a triplex reaction with another methylation marker and ACTB as reference. 50 blood plasma samples from lung cancer patients and 50 blood plasma controls from individuals with benign lung diseases were compared. Calculated AUC=0.834 (for SHOX2 assessed independent from the other rmethylation marker used). Marked points are thresholds for 95% sensitivity resp. 95% specificity.

DETAILED DESCRIPTION OF THE INVENTION

Figure 3A:
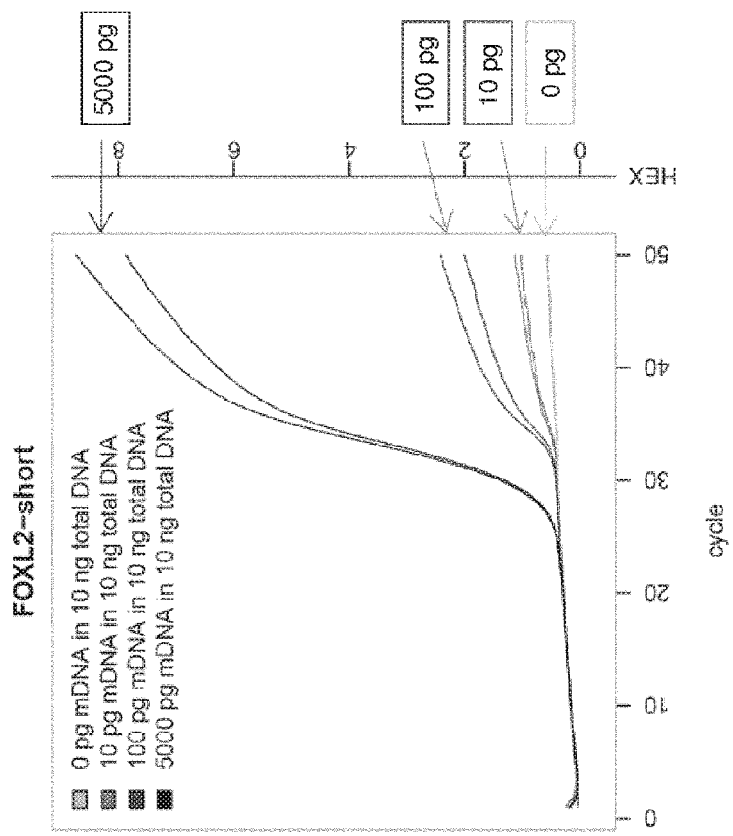
FIGS. 3A-3B: Comparison of a 90 bp realtime PCR assay for FOXL2 without a mismatch in the middle of a primer and a 68 bp for FOXL2 with a methylation unspecific mismatch in the middle of one primer covering and assessing the very same CpGs with their blockers and probes using technical samples.

Before the present invention is described in detail below, it is to be understood that this invention is not limited to the particular methodology, protocols and reagents described herein as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art.

Preferably, the terms used herein are defined as described in "A multilingual glossary of biotechnological terms: (IUPAC Recommendations)", Leuenberger, H. G. W, Nagel, B. and Kölbl, H. eds. (1995), Helvetica Chimica Acta, CH-4010 Basel, Switzerland).

Several documents are cited throughout the text of this specification. Each of the documents cited herein (including all patents, patent applications, scientific publications, manufacturer's specifications, instructions etc.), whether supra or infra, is hereby incorporated by reference in its entirety. Nothing herein is to be construed as an admission that the invention is not entitled to antedate such disclosure by virtue of prior invention.

In the following, the elements of the present invention will be described. These elements are listed with specific embodiments, however, it should be understood that they may be combined in any manner and in any number to create additional embodiments. The variously described examples and preferred embodiments should not be construed to limit the present invention to only the explicitly described embodiments. This description should be understood to support and encompass embodiments which combine the explicitly described embodiments with any number of the disclosed and/or preferred elements. Furthermore, any per-mutations and combinations of all described elements in this application should be considered disclosed by the description of the present application unless the context indicates otherwise.

Throughout this specification and the claims which follow, unless the context requires otherwise, the word "comprise", and variations such as "comprises" and "comprising", are to be understood to imply the inclusion of a stated integer or step or group of integers or steps but not the exclusion of any other integer or step or group of integer or step. As used in this specification and the appended claims, the singular forms "a", "an", and "the" include plural referents, unless the content clearly dictates otherwise.

Aspects of the Invention and Particular Embodiments Thereof

The invention relates to several aspects as set out above in the summary of the invention. These aspects comprise alternative embodiments and preferred embodiments, which are described below.

In a first aspect, the present invention relates to a method for detecting the presence or absence of hypermethylated target DNA in a sample comprising genomic DNA.

In a first basic embodiment of the first aspect, the present invention relates to a method for detecting the presence or absence of hypermethylated target DNA in a sample comprising genomic DNA, wherein said genomic DNA is at least partially fragmented, comprising the steps:
(a) converting, in the DNA, cytosine unmethylated in the 5-position to uracil or another base that does not hybridize to guanine;
(b) amplifying a region of the converted target DNA using methylation-unspecific primer oligonucleotides and at least one methylation-specific blocker blocking the amplification in a methylation-specific manner, wherein said region is less than 100 basepairs (bp) long and comprises at least 3 CpG sites of the genomic DNA not covered by a primer; and
(c) detecting the presence or absence of DNA amplified in step (b),
wherein the presence or absence of amplified DNA reflects the presence or absence, respectively, of hypermethylated target DNA in the sample.

Preferably, the at least one primer oligonucleotide of step (b) covers (1) at least one CpG site with a methylation-unspecific mismatch or a spacer regarding the cytosine base position of the CpG site and/or (2) at least one SNP site with an SNP-unspecific mismatch or a spacer.

In a second basic embodiment of the first aspect, the present invention relates to a method for detecting the presence or absence of hypermethylated target DNA in a sample comprising genomic DNA, comprising the steps:
(a) converting, in the DNA, cytosine unmethylated in the 5-position to uracil or another base that does not hybridize to guanine;
(b) amplifying a region of the converted target DNA using methylation-unspecific primer oligonucleotides and at least one methylation-specific blocker blocking the amplification in a methylation-specific manner, wherein said region comprises at least 3 CpG sites of the genomic DNA not covered by a primer wherein at least one primer oligonucleotide covers (1) at least one CpG site with a methylation-unspecific mismatch or a spacer regarding the cytosine base position of the CpG site and/or (2) at least one SNP site with an SNP-unspecific mismatch or a spacer; and
(c) detecting the presence or absence of DNA amplified in step (b);
wherein the presence or absence of amplified DNA reflects the presence or absence, respectively, of hypermethylated target DNA in the sample.

Preferably, said region is less than 100 basepairs (bp) long.

In the following, preferred embodiments of both the first and the second basic embodiment of the first aspect are described:

In a preferred embodiment, said region is less than 100, 99, 98, 97, 96, 94, 93, 92, 91, 90, 89, 88, 87, 86 85, 84, 83, 82, 81, 80, 79, 78, 77, 76, 75, 74, 73, 72, 71, 70, 69, 68, 67, 66, 65, 64, 63, 62, 61 or 60 bp long, preferably less than 97, 92, 84, 73, 72, 69 or 67 bp long. Preferred ranges for the region are 50 to 99 bp, more preferably 60 to 99 pb and most preferably 60 or 66 to 96 bp, 60 or 66 to 91, 60 or 66 to 83, 60 or 66 to 72, 60 or 66 to 71 or 60 or 66 to 68. In particular (and independent of a general length for other markers), the region is less than 92 bp long with respect to SHOX2, less than 97, 84 or 67 bp long with respect to PTGER4 and/or less than 73, 72 or 69 bp long with respect to FOXL2 (ranges applying correspondingly, i.e. 50, preferably 60 or 66 to 91 (SHOX2), to 96, 83 or 66 (PTGER4) or to 72, 71 or 68 FOXL2. In case of each of the afore-mentioned lengths, said region comprises at least 3, 4, 5, 6, 7, 8, 9, 10, 11, 12, 13, 14 or 15 CpG sites of the genomic DNA, preferably not covered by a primer. Preferably, at least 3, 4, 5, 6, 7, 8, 9, 10, 11, 12, 13, 14 or 15 (but not necessarily all, in particular CpG sites covered by a spacer or methylation-unspecific mismatch) of these CpG sites must be methylated in the hypermethylated target DNA for an amplicon to be generated and/or to be detectable.

In a preferred embodiment, the total number of mismatches and spacers (including both CpG site and SNP site related mismatches and spacers) per primer is 1, 2 or 3, more preferably 1 or 2 and most preferably 1. It is envisaged that only one of the primers or that both of the primers comprises mismatches. If both primers comprise mismatches, the number of mismatches in one primer is independent from the number of mismatches in the other primer.

In a preferred embodiment, the at least one mismatch or spacer, preferably all mismatches and spacers, is/are within the ten nucleotides of the 3' end of the primer oligonucleotide and/or not within the five nucleotides of the 5' end of the primer oligonucleotide. Rather, it is preferred that the at least one mismatch or spacer, preferably all mismatches and spacers, is/are in the middle third or 3' third of the primer oligonucleotide.

In a preferred embodiment, in step (b), the at least one methylation-specific blocker blocking the amplification in a methylation-specific manner blocks the amplification of the region of the target DNA in case the CpG sites of said region, preferably the CpG sites the blocker covers, are not methylated. Thus, only hypermethylated target DNA is amplified.

In a preferred embodiment, in step (c), the presence or absence of DNA amplified in step (b) is detected using a probe, preferably a probe oligonucleotide.

In a preferred embodiment, the methylation-unspecific mismatch is, regarding the cytosine base position of the CpG site (which is a C or U/T due to conversion and subsequent amplification), a T or C instead of a matching A or G, respectively, for the DNA resulting from step (a) or an A or G instead of a matching C or T, respectively, for the strand generated in the first amplification cycle directly from the DNA resulting from step (a).

In a preferred embodiment, said target DNA is genomic human SHOX2, PTGER4 or FOXL2 DNA, including the respective promoter region, and DNA within 5, 4, 3, 2 or 1 kb upstream and downstream thereof. Preferably, it is genomic human SHOX2, PTGER4 or FOXL2 DNA. With respect to SHOX2, the target DNA preferably has a sequence according to SEQ ID NO: 101, more preferably according to SEQ ID NO: 106, even more preferably according to SEQ ID NO: 111 and most preferably according to SEQ ID NO: 116. With respect to PTGER4, the target DNA preferably has a sequence according to SEQ ID NO: 51, more preferably according to SEQ ID NO: 56, even more preferably according to SEQ ID NO: 61, even more preferably according to one of SEQ ID NOs 66, 71, 76 or 81 and most preferably according to one of SEQ ID NOs 86, 91 or 96. With respect to FOXL2, the target DNA preferably has a sequence according to SEQ ID NO: 1, more preferably according to SEQ ID NO: 6 or SEQ ID NO: 11, even more preferably according to one of SEQ ID NOs 16, 21, 26 or 31 and most preferably according to one of SEQ ID NOs 36, 41 or 46. (all before conversion; maps showing the relationship of the preferred target regions for SHOX2, PTGER4 and FOXL2 are shown in FIGS. 1A-1C).

In a second aspect, the present invention relates to a method for detecting the presence or absence of cancer in a subject, comprising the method for detecting the presence or absence of hypermethylated target DNA in a sample comprising genomic DNA according to the first aspect, wherein said sample is a subject-derived sample comprising, in a subject having said cancer, tumor DNA of a cancer cell, said target DNA is hypermethylated in cancer cells of a patient having said cancer, and the presence or absence of hypermethylated target DNA in the sample is indicative for the presence or absence, respectively, of the cancer in the subject.

In a preferred embodiment, the cancer is a cancer selected from the group specified below (see section regarding definitions). Preferably, it is a cancer comprising cancer cells in which the SHOX2, PTGER4 and/or FOXL2 associated region is hypermethylated. More preferably, it is lung cancer or colorectal cancer, most preferably it is lung cancer. More specifically, it is preferably lung cancer for SHOX2, PTGER4 or FOXL2, or colorectal cancer for PTGER4 or FOXL2, more preferably for FOXL2. In each case, the cancer may be any subtype of lung and colorectal cancer specified above. In a more preferred embodiment, the stage of the lung or colorectal cancer is up to any stage III. More preferably, it is at stage 0, IA, IB, IIA or IIB for lung cancer (preferably one or more of stages 0, IA and/or IB), or at stage 0, I, IIA, IIB or IIC for colorectal cancer (preferably one or more of stages 0 and/or IA).

In a preferred embodiment, the indicated presence of the cancer is confirmed with an imaging test (e.g. PET, CT, MRI, X-rays or ultrasound), endoscopy and/or a microscopy assessment of a tissue biopsy.

Related to the second aspect, the present invention also relates to a method of referring a subject having cancer to a cancer treatment, comprising detecting the presence or absence of cancer in a subject according to the second aspect and referring the subject to cancer treatment if a presence of cancer is detected.

Related to the second aspect, the present invention also relates to a method of treating a subject having cancer, comprising detecting the presence of cancer in a subject according to the second aspect and treating the subject with one or more cancer treatments as specified above.

Related to the second aspect, the present invention also relates to a method of caring for a subject suspected of having cancer, comprising detecting the presence or absence of cancer in a subject according to the second aspect and referring or treating the subject according to the above, respectively, if a presence of cancer is detected.

In a third aspect, the present invention relates to a methylation-unspecific primer oligonucleotide suitable, together with another primer oligonucleotide, for generating an amplicon from a single strand of genomic DNA in which cytosine unmethylated in the 5-position has been converted to uracil or another base that does not hybridize to guanine, wherein the at least one primer oligonucleotide covers (1) at least one CpG site with a methylation-unspecific mismatch or a spacer regarding the cytosine base position of the CpG site and/or (2) at least one SNP site with an SNP-unspecific mismatch or a spacer.

Preferably, the primer oligonucleotide is 15-30, more preferably 19-25 nucleotides long.

In a preferred embodiment, said single strand of genomic DNA is of human SHOX2, PTGER4 or FOXL2 DNA, including the respective promoter region, and DNA within 5, 4, 3, 2, or 1 kb upstream and downstream thereof (also referred to herein as human SHOX2, PTGER4 or FOXL2 associated region). Preferably, it is from genomic human SHOX2, PTGER4 or FOXL2 DNA. With respect to SHOX2, the single strand of genomic DNA preferably has a sequence (before conversion) according to SEQ ID NO: 101, more preferably according to SEQ ID NO: 106, even more preferably according to SEQ ID NO: 111 and most preferably according to SEQ ID NO: 116; or, respectively, a sequence reverse complementary thereto. With respect to PTGER4, the target DNA preferably has a sequence (before conversion) according to SEQ ID NO: 51, more preferably according to SEQ ID NO: 56, even more preferably according to SEQ ID NO: 61, even more preferably according to one of SEQ ID NOs 66, 71, 76 or 81 and most preferably according to one of SEQ ID NOs 86, 91 or 96; or, respectively, a sequence reverse complementary thereto. With respect to FOXL2, the target DNA preferably has a sequence according to SEQ ID NO: 1, more preferably according to SEQ ID NO: 6 or SEQ ID NO: 11, even more preferably according to one of SEQ ID NOs 16, 21, 26 or 31 and most preferably according to one of SEQ ID NOs 36, 41 or 46; or, respectively, a sequence reverse complementary thereto (all before conversion; maps showing the relationship of the preferred target regions for SHOX2, PTGER4 and FOXL2 are shown in FIGS. 1A-1C).

In a preferred embodiment, the primer oligonucleotide has a sequence that is substantially identical to a 15-30 nucleotide long segment of the sequence according to (a) SEQ ID NO: 102, 103, 104 or 105;
(b) SEQ ID NO: 52, 53, 54, or 55; or
(c) SEQ ID NO: 2, 3, 4 or 5;

wherein a substantially identical sequence comprises at least one methylation-unspecific mismatch or spacer regarding the cytosine base position of a CpG site with respect to the genomic DNA (i.e. unconverted DNA from which the respective SEQ ID is derived, see Table 1).

With respect to (a), the primer oligonucleotide has a sequence that is substantially identical to a 15-30 nucleotide long segment of the sequence according to SEQ ID NO: (107, 108, 109 or 110), more preferably according to SEQ ID NO: (112, 113, 114 or 115), most preferably according to SEQ ID NO: (117, 118, 119 or 120). With respect to (b), the primer oligonucleotide has a sequence that is substantially identical to a 15-30 nucleotide long segment of the sequence according to SEQ ID NO: (57, 58, 59 or 60), more preferably according to SEQ ID NO: (62, 63, 64 or 65), even more preferably according one of SEQ ID NO: (67, 68, 69 or 70), SEQ ID NO: (72, 73, 74 or 75), SEQ ID NO: (77, 78, 79 or 80) or SEQ ID NO: (82, 83, 84 or 85), and most preferably according to one of SEQ ID NO: (87, 88, 89 or 90), SEQ ID NO: (92, 93, 94 or 95) or SEQ ID NO: (97, 98, 99 or 100). With respect to (c), the primer oligonucleotide has a sequence that is substantially identical to a 15-30 nucleotide long segment of the sequence according to SEQ ID NO: (7, 8, 9 or 10) or SEQ ID NO: (12, 23, 24 or 15), more preferably according to one of SEQ ID NO: (17, 18, 19, 20), SEQ ID NO: (22, 23, 24 or 25), SEQ ID NO: (27, 28, 29 or 30) or SEQ ID NO: (32, 33, 24 or 35), and most preferably according to one of SEQ ID NO: (37, 38, 39 or 40), SEQ ID NO: (42, 43, 44 or 45) or SEQ ID NO: (47, 48, 49 or 50) (maps showing the relationship of the preferred target regions for SHOX2, PTGER4 and FOXL2 are shown in FIGS. 1A-1C).

Preferably, the mismatch is either due to a substitution of one C by an A or G in SEQ ID NO: 2, 5, 7, 10, 12, 15, 17, 20, 22, 25, 27, 30, 32, 35, 37, 40, 42, 45, 47, 50, 52, 55, 57, 60, 62, 65, 67, 70, 72, 75, 77, 80, 82, 85, 87, 90, 92, 95, 97, 100, 102, 105, 107, 110, 112, 115, 117 or 120, or due to a substitution of one G by a T or C in SEQ ID NO: 3, 4, 8, 9, 13, 14, 18, 19, 23, 24, 28, 29, 33, 34, 38, 39, 43, 44, 48, 49, 53, 54, 58, 59, 63, 64, 68, 69, 73, 74, 78, 79, 83, 84, 88, 89, 93, 94, 98, 99, 103, 104, 108, 109, 113, 114, 118 or 119.

Preferably, the segment is 19-25 nucleotides long.

In a preferred embodiment, the total number of mismatches and spacers (including both CpG site and SNP related mismatches and spacers) is 1, 2 or 3, more preferably 1 or 2 and most preferably 1.

In a preferred embodiment, the at least one mismatch or spacer, preferably all mismatches and spacers, is/are within the ten nucleotides of the 3' end, and/or not within the five nucleotides of the 5' end of the primer oligonucleotide. Rather, it is preferred that the at least one mismatch or spacer, preferably all mismatches and spacers, is/are in the middle third or 3' third of the primer oligonucleotide.

In a particularly preferred embodiment, the primer oligonucleotide has a sequence according to SEQ ID NO: 121 or 122 or a variant thereof (with respect to (a)), SEQ ID NO: 140, 141, 144, 145, 148 or 149 or a variant thereof (with respect to (b), or SEQ ID NO: 126, 127, 130, 131, 135 or 136 or a variant thereof (with respect to (c). A variant in this respect is a sequence that is shifted up to 10, 9, 8, 7, 6, 5, 4, 3, 2 or 1, preferably up to 5, more preferably up to 3 nucleotides upstream or downstream (regarding the respective target sequence) and/or is up to 10, 9, 8, 7, 6, 5, 4, 3, 2 or 1, preferably up to 5, more preferably up to 3 nucleotides longer or shorter (regarding the respective target sequence, i.e. while still annealing to the respective target sequence).

In a fourth aspect, the present invention relates to a kit suitable for performing the method of the first aspect.

In a first basic embodiment of the fourth aspect, the present invention relates to a kit comprising
(i) at least one pair of methylation-unspecific primer oligonucleotides consisting of a forward and a reverse primer, wherein said pair of primers is suitable for generating an amplicon from a single strand of genomic DNA in which cytosine unmethylated in the 5-position has been converted to uracil or another base that does not hybridize to guanine, wherein said genomic DNA is at least partially fragmented, and wherein said amplicon is less than 100 bp long and comprises at least 3 CpG sites of the genomic DNA not covered by a primer; and
(ii) at least one methylation-specific blocker capable of blocking the amplification in a methylation-specific manner.

Preferably, at least one primer oligonucleotides covers (1) at least one CpG site with a methylation-unspecific mismatch or a spacer regarding the cytosine base position of the CpG site and/or (2) at least one SNP site with an SNP-unspecific mismatch or a spacer.

In a preferred embodiment of the first basic embodiment of the fourth aspect, the kit comprises:
(i) one or more of the following (a) to (c):
  (a) a primer pair A consisting of a forward primer oligonucleotide with a sequence that is identical or substantially identical to a 15-30 nucleotide long segment of the sequence according to SEQ ID NO: 102 and a reverse primer oligonucleotide with a sequence that is identical or substantially identical to a 15-30 nucleotide long segment of the sequence according to SEQ ID NO: 103; and/or a primer pair B consisting of a forward primer oligonucleotide with a sequence that is identical or substantially identical to a 15-30 nucleotide long segment of the sequence according to SEQ ID NO: 104 and a reverse primer oligonucleotide with a sequence that is identical or substantially identical to a 15-30 nucleotide long segment of the sequence according to SEQ ID NO: 105;
  (b) a primer pair A consisting of a forward primer oligonucleotide with a sequence that is identical or substantially identical to a 15-30 nucleotide long segment of the sequence according to SEQ ID NO: 52 and a reverse primer oligonucleotide with a sequence that is identical or substantially identical to a 15-30 nucleotide long segment of the sequence according to SEQ ID NO: 53; and/or a primer pair B consisting of a forward primer oligonucleotide with a sequence that is identical or substantially identical to a 15-30 nucleotide long segment of the sequence according to SEQ ID NO: 54 and a reverse primer oligonucleotide with a sequence that is identical or substantially identical to a 15-30 nucleotide long segment of the sequence according to SEQ ID NO: 55; and/or
  (c) a primer pair A consisting of a forward primer oligonucleotide with a sequence that is identical or substantially identical to a 15-30 nucleotide long segment of the sequence according to SEQ ID NO: 2 and a reverse primer oligonucleotide with a sequence that is identical or substantially identical to a 15-30 nucleotide long segment of the sequence according to SEQ ID NO: 3; and/or a primer pair B consisting of a forward primer oligonucleotide with a sequence that is identical or substantially identical to a 15-30 nucleotide long segment of the sequence according to SEQ ID NO: 4 and a reverse primer oligonucleotide with a sequence that is identical or substantially identical to a 15-30 nucleotide long segment of the sequence according to SEQ ID NO: 5;
  wherein a substantially identical sequence comprises at least one methylation-unspecific mismatch or spacer, wherein the at least one methylation-unspecific mismatch in a forward primer A or a reverse primer B is due to substitution of C by A or G, and in a forward primer B or a reverse primer A it is due to a substitution of G by T or C, and the methylation-unspecific spacer is a spacer instead of a C in a forward primer A or a reverse primer B, and a spacer instead of a G in a forward primer B or a reverse primer A, and wherein in each case the amplicon producible using the primer pairs A or B with template DNA according to (a) SEQ ID NO: 101, (b) SEQ ID NO: 51 and (c) SEQ ID NO: 1 is less than 100 basepairs (bp) long;

(ii) one or more of the following (a) to (c), respectively:
  (a) at least one blocker oligonucleotide with a length of 20 to 40 nucleotides for a primer pair A, wherein the at least one blocker oligonucleotide has a sequence identical with a segment of the sequence according to SEQ ID NO: 102, wherein in said segment all C's are substituted by T's or wherein the at least one blocker oligonucleotide has a sequence identical with a segment of the sequence according to SEQ ID NO: 103, wherein in said segment all G's are substituted by A's; or for a primer pair B wherein the at least one blocker oligonucleotide has a sequence identical with a segment of the sequence according to SEQ ID NO: 104, wherein in said segment all G's are substituted by A's or wherein the at least one blocker oligonucleotide has a sequence identical with a segment of the sequence according to SEQ ID NO: 105, wherein in said segment all C's are substituted by T's;
  (b) at least one blocker oligonucleotide with a length of 20 to 40 nucleotides for a primer pair A, wherein the at least one blocker oligonucleotide has a sequence identical with a segment of the sequence according to SEQ ID NO: 52, wherein in said segment all C's are substituted by T's or wherein the at least one blocker oligonucleotide has a sequence identical with a segment of the sequence according to SEQ ID NO: 53, wherein in said segment all G's are substituted by A's; or for a primer pair B wherein the at least one blocker oligonucleotide has a sequence identical with a segment of the sequence according to SEQ ID NO: 54, wherein in said segment all G's are substituted by A's or wherein the at least one blocker oligonucleotide has a sequence identical with a segment of the sequence according to SEQ ID NO: 55, wherein in said segment all C's are substituted by T's; and/or
  (c) at least one blocker oligonucleotide with a length of 20 to 40 nucleotides for a primer pair A, wherein the at least one blocker oligonucleotide has a sequence identical with a segment of the sequence according to SEQ ID NO: 2, wherein in said segment all C's are substituted by T's or wherein the at least one blocker oligonucleotide has a sequence identical with a segment of the sequence according to SEQ ID NO: 3, wherein in said segment all G's are substituted by A's; or for a primer pair B wherein the at least one blocker oligonucleotide has a sequence identical with a segment of the sequence according to SEQ ID NO: 4, wherein in said segment all G's are substituted by A's or wherein the at least one blocker oligonucleotide has a sequence identical with a segment of the sequence according to SEQ ID NO: 5, wherein in said segment all C's are substituted by T's;
  wherein any of said segments of blocker oligonucleotides is at least partially downstream in 5'→3' direction of the 5' end of a forward or reverse primer of primer pair A or B and overlaps or does not overlap (preferably it overlaps) with the primer sequence (irrespective of said blocker oligonucleotide substitutions) and wherein a non-overlapping segment does not overlap or does not substantially overlap with the reverse complement sequence of the opposite primer of the primer pair (irrespective of said blocker oligonucleotide substitutions) ("does not substantially overlap" means that it may overlap with up to 5, 4, 3, 2 or 1 nucleotides provided that the overlap is not large enough such that it serves as a template for said opposite primer, i.e. such that the opposite primer binds to the blocker and the polymerase extends the primer); and optionally
(iii) one or more of the following (a) to (c), respectively:
  (a) a probe oligonucleotide A with a sequence that is identical to a 10-25 nucleotide long segment of the sequence according to SEQ ID NO: 102 or 103; and/or a probe oligonucleotide B with a sequence that is identical to a 10-25 nucleotide long segment of the sequence according to SEQ ID NO: 104 or 105;
  (b) a probe oligonucleotide A with a sequence that is identical to a 10-25 nucleotide long segment of the sequence according to SEQ ID NO: 52 or 53; and/or a probe oligonucleotide B with a sequence that is identical to a 10-25 nucleotide long segment of the sequence according to SEQ ID NO: 54 or 55; and/or
  (c) a probe oligonucleotide A with a sequence that is identical to a 10-25 nucleotide long segment of the sequence according to SEQ ID NO: 2 or 3; and/or a probe oligonucleotide B with a sequence that is identical to a 10-25 nucleotide long segment of the sequence according to SEQ ID NO: 4 or 5;
wherein probe oligonucleotides are methylation-specific and anneal to a single strand of the amplicon producible according to (i) where none of said primer oligonucleotides anneals.

Preferably, at least one primer oligonucleotide, more preferably at least one primer oligonucleotide of each of the primer pairs A and/or B, comprises at least one methylation-unspecific mismatch or spacer.

In a second basic embodiment of the fourth aspect, the present invention relates to a kit comprising
(i) at least one pair of methylation-unspecific primer oligonucleotides consisting of a forward and a reverse primer, wherein said pair of primers is suitable for generating an amplicon from a single strand of genomic DNA in which cytosine unmethylated in the 5-position has been converted to uracil or another base that does not hybridize to guanine, wherein said amplicon comprises at least 3 CpG sites of the genomic DNA not covered by a primer, and wherein at least one primer oligonucleotides covers (1) at least one CpG site with a methylation-unspecific mismatch or a spacer regarding the cytosine base position of the CpG site and/or (2) at least one SNP site with an SNP-unspecific mismatch or a spacer; and
(ii) at least one methylation-specific blocker capable of blocking the amplification in a methylation-specific manner.

Preferably, said amplicon is less than 100 bp long.

In a preferred embodiment of the second basic embodiment of the fourth aspect, the kit comprises:
(i) one or more of the following (a) to (c):
  (a) a primer pair A consisting of a forward primer oligonucleotide with a sequence that is substantially identical to a 15-30 nucleotide long segment of the sequence according to SEQ ID NO: 102 and a reverse primer oligonucleotide with a sequence that is substantially identical to a 15-30 nucleotide long segment of the sequence according to SEQ ID NO: 103; and/or a primer pair B consisting of a forward primer oligonucleotide with a sequence that is substantially identical to a 15-30 nucleotide long segment of the sequence according to SEQ ID NO: 104 and a reverse primer oligonucleotide with a sequence that is substantially identical to a 15-30 nucleotide long segment of the sequence according to SEQ ID NO: 105;
  (b) a primer pair A consisting of a forward primer oligonucleotide with a sequence that is substantially identical to a 15-30 nucleotide long segment of the sequence according to SEQ ID NO: 52 and a reverse primer oligonucleotide with a sequence that is substantially identical to a 15-30 nucleotide long segment of the sequence according to SEQ ID NO: 53; and/or a primer pair B consisting of a forward primer oligonucleotide with a sequence that is substantially identical to a 15-30 nucleotide long segment of the sequence according to SEQ ID NO: 54 and a reverse primer oligonucleotide with a sequence that is substantially identical to a 15-30 nucleotide long segment of the sequence according to SEQ ID NO: 55; and/or (c) a primer pair A consisting of a forward primer oligonucleotide with a sequence that is substantially identical to a 15-30 nucleotide long segment of the sequence according to SEQ ID NO: 2 and a reverse primer oligonucleotide with a sequence that is substantially identical to a 15-30 nucleotide long segment of the sequence according to SEQ ID NO: 3; and/or a primer pair B consisting of a forward primer oligonucleotide with a sequence that is substantially identical to a 15-30 nucleotide long segment of the sequence according to SEQ ID NO: 4 and a reverse primer oligonucleotide with a sequence that is substantially identical to a 15-30 nucleotide long segment of the sequence according to SEQ ID NO: 5;

wherein a substantially identical sequence comprises at least one methylation-unspecific mismatch or spacer, wherein the at least one methylation-unspecific mismatch in a forward primer A or a reverse primer B is due to substitution of C by A or G, and in a forward primer B or a reverse primer A it is due to a substitution of G by T or C, and the methylation-unspecific spacer is a spacer instead of a C in a forward primer A or a reverse primer B, and a spacer instead of a G in a forward primer B or a reverse primer A;

(ii) one or more of the following (a) to (c), respectively:
(a) at least one blocker oligonucleotide with a length of 20 to 40 nucleotides for a primer pair A, wherein the at least one blocker oligonucleotide has a sequence identical with a segment of the sequence according to SEQ ID NO: 102, wherein in said segment all C's are substituted by T's or wherein the at least one blocker oligonucleotide has a sequence identical with a segment of the sequence according to SEQ ID NO: 103, wherein in said segment all G's are substituted by A's; or for a primer pair B wherein the at least one blocker oligonucleotide has a sequence identical with a segment of the sequence according to SEQ ID NO: 104, wherein in said segment all G's are substituted by A's or wherein the at least one blocker oligonucleotide has a sequence identical with a segment of the sequence according to SEQ ID NO: 105, wherein in said segment all C's are substituted by T's;

(b) at least one blocker oligonucleotide with a length of 20 to 40 nucleotides for a primer pair A, wherein the at least one blocker oligonucleotide has a sequence identical with a segment of the sequence according to SEQ ID NO: 52, wherein in said segment all C's are substituted by T's or wherein the at least one blocker oligonucleotide has a sequence identical with a segment of the sequence according to SEQ ID NO: 53, wherein in said segment all G's are substituted by A's; or for a primer pair B wherein the at least one blocker oligonucleotide has a sequence identical with a segment of the sequence according to SEQ ID NO: 54, wherein in said segment all G's are substituted by A's or wherein the at least one blocker oligonucleotide has a sequence identical with a segment of the sequence according to SEQ ID NO: 55, wherein in said segment all C's are substituted by T's; and/or (c) at least one blocker oligonucleotide with a length of 20 to 40 nucleotides for a primer pair A, wherein the at least one blocker oligonucleotide has a sequence identical with a segment of the sequence according to SEQ ID NO: 2, wherein in said segment all C's are substituted by T's or wherein the at least one blocker oligonucleotide has a sequence identical with a segment of the sequence according to SEQ ID NO: 3, wherein in said segment all G's are substituted by A's; or for a primer pair B wherein the at least one blocker oligonucleotide has a sequence identical with a segment of the sequence according to SEQ ID NO: 4, wherein in said segment all G's are substituted by A's or wherein the at least one blocker oligonucleotide has a sequence identical with a segment of the sequence according to SEQ ID NO: 5, wherein in said segment all C's are substituted by T's;

wherein any of said segments of blocker oligonucleotides is at least partially downstream in 5'→3' direction of the 5' end of a forward or reverse primer of primer pair A or B and overlaps or does not overlap (preferably it overlaps) with the primer sequence (irrespective of said blocker oligonucleotide substitutions) and wherein a non-overlapping segment does not overlap or does not substantially overlap with the reverse complement sequence of the opposite primer of the primer pair (irrespective of said blocker oligonucleotide substitutions) ("does not substantially overlap" means that it may overlap with up to 5, 4, 3, 2 or 1 nucleotides provided that the overlap is not large enough such that it serves as a template for said opposite primer, i.e. such that the opposite primer binds to the blocker and the polymerase extends the primer); and optionally (iii) one or more of the following (a) to (c), respectively:
(a) a probe oligonucleotide A with a sequence that is identical to a 10-25 nucleotide long segment of the sequence according to SEQ ID NO: 102 or 103; and/or a probe oligonucleotide B with a sequence that is identical to a 10-25 nucleotide long segment of the sequence according to SEQ ID NO: 104 or 105;
(b) a probe oligonucleotide A with a sequence that is identical to a 10-25 nucleotide long segment of the sequence according to SEQ ID NO: 52 or 53; and/or a probe oligonucleotide B with a sequence that is identical to a 10-25 nucleotide long segment of the sequence according to SEQ ID NO: 54 or 55; and/or
(c) a probe oligonucleotide A with a sequence that is identical to a 10-25 nucleotide long segment of the sequence according to SEQ ID NO: 2 or 3; and/or a probe oligonucleotide B with a sequence that is identical to a 10-25 nucleotide long segment of the sequence according to SEQ ID NO: 4 or 5;

wherein probe oligonucleotides are methylation-specific and anneal to a single strand of the amplicon producible according to (i) where none of said primer oligonucleotides anneals.

Preferably, in each case the amplicon producible using the primer pairs A or B with template DNA according to (a) SEQ ID NO: 101, (b) SEQ ID NO: 51 and (c) SEQ ID NO: 1 is less than 100 basepairs (bp) long.

In the following, preferred embodiments of both the first and the second basic embodiment of the first aspect are described:

In a preferred embodiment, said single strand of genomic DNA is of human SHOX2, PTGER4 or FOXL2 DNA, including the respective promoter region, and DNA within 5, 4, 3, 2, or 1 kb upstream and downstream thereof. Preferably, it is from genomic human SHOX2, PTGER4 or FOXL2 DNA. With respect to SHOX2, the single strand of genomic DNA preferably has a sequence according to SEQ ID NO: 101, more preferably according to SEQ ID NO: 106, even more preferably according to SEQ ID NO: 111 and most preferably according to SEQ ID NO: 116; or, respectively, a sequence reverse complementary thereto. With respect to PTGER4, the single strand of genomic DNA preferably has a sequence according to SEQ ID NO: 51, more preferably according to SEQ ID NO: 56, even more preferably according to SEQ ID NO: 61, even more preferably according to one of SEQ ID NOs 66, 71, 76 or 81 and most preferably according to one of SEQ ID NOs 86, 91 or 96; or, respectively, a sequence reverse complementary thereto. With respect to FOXL2, the single strand of genomic DNA preferably has a sequence according to SEQ ID NO: 1, more preferably according to SEQ ID NO: 6 or SEQ ID NO: 11, even more preferably according to one of SEQ ID NOs 16, 21, 26 or 31 and most preferably according to one of SEQ ID NOs 36, 41 or 46; or, respectively, a sequence reverse complementary thereto (all before conversion; maps showing the relationship of the preferred target regions for SHOX2, PTGER4 and FOXL2 are shown in FIGS. 1A-1C).

In a preferred embodiment, said amplicon is less than 100, 99, 98, 97, 96, 94, 93, 92, 91, 90, 89, 88, 87, 86 85, 84, 83, 82, 81, 80, 79, 78, 77, 76, 75, 74, 73, 72, 71, 70, 69, 68, 67, 66, 65, 64, 63, 62, 61 or 60 bp long, preferably less than 97, 92, 84, 73, 72, 69 or 67 bp long, Preferred ranges for the region are 50 to 99 bp, more preferably 60 to 99 bp and most preferably 60 or 66 to 96 bp, 60 or 66 to 91, 60 or 66 to 83, 60 or 66 to 72, 60 or 66 to 71 or 60 or 66 to 68. In particular (and independent of a general length for other markers), the region is less than 92 bp long with respect to SHOX2, less than 97, 84 or 67 bp long with respect to PTGER4 and/or less than 73, 72 or 69 bp long with respect to FOXL2 (ranges applying correspondingly, i.e. 50, preferably 60 or 66 to 91 (SHOX2), to 96, 83 or 66 (PTGER4) or to 72, 71 or 68 (FOXL2). In case of each of the afore-mentioned lengths, said amplicon comprises at least 3, 4, 5, 6, 7, 8, 9, 10, 11, 12, 13, 14 or 15 CpG sites of the genomic DNA, preferably not covered by a primer. Preferably, at least 3, 4, 5, 6, 7, 8, 9, 10, 11, 12, 13, 14 or 15 (but not necessarily all, in particular CpG sites covered by a spacer or methylation-unspecific mismatch) of these CpG sites must be methylated in the hypermethylated target DNA for an amplicon to be generated.

In a preferred embodiment, the total number of mismatches and spacers per primer (including both CpG site and SNP related mismatches and spacers) is 1, 2 or 3, more preferably 1 or 2 and most preferably 1. It is envisaged that only one of the primers or that both of the primers comprises mismatches. If both primers comprise mismatches, the number of mismatches in one primer is independent from the number of mismatches in the other primer.

In a preferred embodiment, the at least one mismatch or spacer, preferably all mismatches and spacers, is/are within the ten nucleotides of the 3' end and/or not within the five nucleotides of the 5' end of the primer oligonucleotide. Rather, it is preferred that the at least one mismatch or spacer, preferably all mismatches and spacers, is/are in the middle third or 3' third of the primer oligonucleotide.

In a preferred embodiment, the kit further comprises (iii) at least one methylation-specific probe, preferably probe oligonucleotide.

With respect to (a) of (i), (ii) and (iii), the segment is preferably of the sequence according to SEQ ID NO: (107, 108, 109 or 110, respectively), more preferably according to SEQ ID NO: (112, 113, 114 or 115, respectively), respectively, and most preferably according to SEQ ID NO: (117, 118, 119 or 120, respectively).

With respect to (b) of (i), (ii) and (iii), the segment is preferably of the sequence according to SEQ ID NO: (57, 58, 59 or 60, respectively), more preferably according to SEQ ID NO: (62, 63, 64 or 65, respectively), even more preferably according one of SEQ ID NO: (67, 68, 69 or 70, respectively), SEQ ID NO: (72, 73, 74 or 75, respectively), SEQ ID NO: (77, 78, 79 or 80, respectively) or SEQ ID NO: (82, 83, 84 or 85, respectively), and most preferably according to one of SEQ ID NO: (87, 88, 89 or 90, respectively), SEQ ID NO: (92, 93, 94 or 95, respectively) or SEQ ID NO: (97, 98, 99 or 100, respectively).

With respect to (c) of (i), (ii) and (iii), the segment is preferably of the sequence according to SEQ ID NO: (7, 8, 9 or 10, respectively) or SEQ ID NO: (12, 23, 24 or 15, respectively), more preferably according to one of SEQ ID NO: (17, 18, 19, 20, respectively), SEQ ID NO: (22, 23, 24 or 25, respectively), SEQ ID NO: (27, 28, 29 or 30, respectively) or SEQ ID NO: (32, 33, 24 or 35, respectively), and most preferably according to one of SEQ ID NO: (37, 38, 39 or 40, respectively), SEQ ID NO: (42, 43, 44 or 45, respectively) or SEQ ID NO: (47, 48, 49 or 50, respectively) (maps showing the relationship of the preferred target regions for SHOX2, PTGER4 and FOXL2 are shown in FIGS. 1A-1C).

In a preferred embodiment, the kit further comprises a reagent capable of converting an unmethylated cytosine to uracil or to another base that is detectably dissimilar to cytosine in terms of hybridization properties and/or reagents such as buffers, nucleotides and/or polymerase for carrying out a PCR reaction.

In a particularly preferred embodiment, the kit comprises
(for SHOX2 as a target) a forward primer with a sequence according to SEQ ID NO: 121 or a variant thereof, a reverse primer with a sequence according to SEQ ID NO: 122 or a variant thereof, one or two blockers with a sequence selected from SEQ ID NO: 123 and 124 and variants thereof, and optionally a probe with a sequence according to SEQ ID NO: 122, the reverse complement thereof, or a variant of either one;

(for FOXL2 as a target) a forward primer with a sequence according to SEQ ID NO: 126 or a variant thereof, a reverse primer with a sequence according to SEQ ID NO: 127 or a variant thereof, a blocker with a sequence according to SEQ ID NO: 128 or a variant thereof, and optionally a probe with a sequence according to SEQ ID NO: 129, the reverse complement thereof, or a variant of either one;

(for FOXL2 as a target) a forward primer with a sequence according to SEQ ID NO: 130 or a variant thereof, a reverse primer with a sequence according to SEQ ID NO: 131 or a variant thereof, one or two blockers with a sequence selected from SEQ ID NO: 132 and 133 and variants thereof, and optionally a probe with a sequence according to SEQ ID NO: 134, the reverse complement thereof, or a variant of either one;

(for FOXL2 as a target) a forward primer with a sequence according to SEQ ID NO: 135 or a variant thereof, a reverse primer with a sequence according to SEQ ID NO: 136 or a variant thereof, one or two blockers with a sequence selected from SEQ ID NO: 137 and 138 and variants thereof, and optionally a probe with a sequence according to SEQ ID NO: 139, the reverse complement thereof, or a variant of either one;

(for PTGER4 as a target) a forward primer with a sequence according to SEQ ID NO: 140 or a variant thereof, a reverse primer with a sequence according to SEQ ID NO: 141 or a variant thereof, a blocker with a sequence according to SEQ ID NO: 142 or a variant thereof, and optionally a probe with a sequence according to SEQ ID NO: 143, the reverse complement thereof, or a variant of either one;

(for PTGER4 as a target) a forward primer with a sequence according to SEQ ID NO: 144 or a variant thereof, a reverse primer with a sequence according to SEQ ID NO: 145 or a variant thereof, a blocker with a sequence according to SEQ ID NO: 146 or a variant thereof, and optionally a probe with a sequence according to SEQ ID NO: 147, the reverse complement thereof, or a variant of either one; and/or (for PTGER4 as a target) a forward primer with a sequence according to SEQ ID NO: 148 or a variant thereof, a reverse primer with a sequence according to SEQ ID NO: 149 or a variant thereof, a blocker with a sequence according to SEQ ID NO: 150 or a variant thereof, and optionally a probe with a sequence according to SEQ ID NO: 151, the reverse complement thereof, or a variant of either one.

A variant in this respect is a sequence that is shifted up to 10, 9, 8, 7, 6, 5, 4, 3, 2 or 1, preferably up to 5, more preferably up to 3 nucleotides upstream or downstream (regarding the respective target sequence) and/or is up to 10, 9, 8, 7, 6, 5, 4, 3, 2 or 1, preferably up to 5, more preferably up to 3 nucleotides longer or shorter (regarding the respective target sequence, i.e. while still annealing to the respective target sequence).

In a fifth aspect, the present invention relates to the use of the methylation-unspecific primer oligonucleotide of the third aspect or the kit of the fourth aspect for detecting the presence or absence of cancer in a subject.

The use is in particular for the method of the first or second aspect of the invention.

Definitions and Further Embodiments of the Invention

The specification uses a variety of terms and phrases, which have certain meanings as defined below. Preferred meanings are to be construed as preferred embodiments of the aspects of the invention described herein. As such, they and also further embodiments described in the following can be combined with any embodiment of the aspects of the invention and in particular any preferred embodiment of the aspects of the invention described above.

The term "detecting" as used herein refers to at least qualitatively analysing for the presence or absence of hypermethylated target DNA. Hypermethylation is preferably determined at 1 or more, 2 or more, 3 or more, 4 or more, 5 or more, 6 or more, 10 or more, 15 or more or 30 or more CpG sites of the target DNA. Usually, the CpG sites analysed are co-methylated in cancer, such that also CpG sites of neighbouring DNA are methylated and can be analysed in addition or instead. "At least qualitatively" means that also a quantitative determination of hypermethylated target DNA, if present, can be performed. Such a "determining the amount" can be performed as described herein. Generally, the quantification may be absolute, e.g. in pg per mL or ng per mL sample, copies per mL sample, number of PCR cycles etc., or it may be relative, e.g. 10 fold higher than in a control sample or as percentage of methylation of a reference control. Determining the amount of hypermethylated target DNA in the sample may comprise normalizing for the amount of total DNA in the sample. Normalizing for the amount of total DNA in the test sample preferably comprises calculating the ratio of the amount of hypermethylated target DNA and the amount of genomic DNA of a reference site. The reference site can be any genomic site and does not have to be a gene. An example is a site comprising short DNA repeats. In case of a reference gene, the gene is preferably a housekeeping gene.

A housekeeping gene is a constitutively expressed gene involved in or required for the maintenance of basic cellular function and is expressed in all cells of an organism under normal and patho-physiological conditions and is therefore expected to be available even if a genome is partially affected by chromosomal instability and deletions. In humans alone, there are more than 2000 housekeeping genes (see Chang et al., PLoS ONE 6(7): e22859. doi:10.1371/journal.pone.0022859, which is hereby incorporated by reference), which may all be used according to the invention. None-limiting examples are Human acidic ribosomal protein (HuPO), β-Actin (BA), Cyclophylin (CYC), Glyceraldehyde-3-phosphate dehydrogenase (GAPDH), Phosphoglycerokinase (PGK), 32-Microglobulin (B2M), 3-Glucuronidase (GUS), Hypoxanthine phosphoribosyltransferase (HPRT), Transcription factor IID TATA binding protein (TBP), Transferrin receptor (TfR), Elongation factor-1-α (EF-1-α), Metastatic lymph node 51 (MLN51) and Ubiquitin conjugating enzyme (UbcH5B).

The amount of hypermethylated target DNA in the sample is the proportion of hypermethylated target DNA relative to the amount of hypermethylated target DNA in a reference sample comprising substantially fully methylated genomic DNA. Preferably, determining the proportion of hypermethylated target DNA comprises determining the amount of hypermethylated DNA of the same target in a reference sample, inter sample normalization of total methylated DNA preferably by using the methylation unspecific measurement of a reference site, and dividing the ratio derived from the test sample by the corresponding ratio derived from the reference sample. The proportion can be expressed as a percentage or PMR as defined below by multiplying the result of the division by 100.

Alternatively, in particular if the amount of hypermethylated target DNA is determined by real-time PCR, it may be calculated by using the cycle threshold (Ct) values for the target and a reference site, preferably in a housekeeping gene (hkg) from samples of subjects and the reference (ref) sample (methylated at least at the target locus) as follows: amount=$100 * x^{-((Ct_{target}-Ct_{hkg})-(Ct_{target ref}-Ct_{hkg ref}))}$, wherein x is the assumed PCR efficiency, which preferably is between 1 to 3 and more preferably is 2.

The term "reference sample" refers to a sample comprising control DNA with known DNA concentration and known target methylation state. The control DNA is preferably, but not necessarily, human DNA that is artificially methylated, preferably substantially fully methylated. In a preferred embodiment, the artificial methylation is achieved by using DNA-Methyltransferases. The DNA itself can be, for example, cell line DNA, plasmid DNA, artificial DNA, or combinations/mixtures thereof.

DNA methylated at the target locus is preferably cell line DNA from one or more cell lines, preferably of those that are well characterized and of which the genomic target methylation state is known and/or of which the target is known to be substantially fully methylated. Substantially fully methylated genomic DNA preferably is DNA, particularly genomic DNA, which has all or substantially all CpG sites methylated. "Substantially all" in this respect means at least 95%, 96%, 97%, 98%, 99%, 99.5% or 99.9%. In a preferred embodiment, the methylation of all or substantially all CpG sites is achieved by treating the DNA with a CpG methyltransferase in a manner that provides for the methylation of all or substantially all CpG sites.

Preferably, the amount of hypermethylated target DNA is expressed as a PMR value. The term "PMR", "Percentage of Methylated Reference", or "Percentage of fully Methylated Reference" describes the degree of methylation and is usually calculated by dividing the gene to reference ratio by the gene to completely methylated reference ratio (obtained, e.g. by CpG methyltransferase, for example SssI treatment of the normally unmethylated reference) and multiplying by 100. The determination of the PMR is described in detail in Ogino et al. (JMD May 2006, Vol. 8, No. 2), which is incorporated by reference. The PMR may alternatively be calculated with the □□Ct method by using the real-time PCR cycle threshold (Ct) values for shox2 and a reference site e.g. in a housekeeping gene (hkg) from samples of patients and the reference (ref) sample (methylated at the target locus) as follows: $\square\square Ct=((Ct_{target}-Ct_{hkg})-(Ct_{targetref}-Ct_{hkgref}))$; $PMR=100*x^{-\square\square Ct}$, wherein x is the assumed PCR efficiency. Generally, the PCR efficiency is assumed to be between 1-3, preferably it is 2 or nearly 2. Preferably, PMRs are the median PMR over at least 3, more preferably 4-8, most preferably 6 experimental repetitions or parallel experiments.

The term "hypermethylated" as used herein relates to "methylation" or "DNA methylation", which refers to a biochemical process involving the addition of a methyl group to the cytosine or adenine DNA nucleotides. DNA methylation at the 5 position of cytosine, especially in promoter regions, can have the effect of reducing gene expression and has been found in every vertebrate examined. In adult non-gamete cells, DNA methylation typically occurs in a CpG site. The term "CpG site" or "CpG dinucleotide", as used herein, refers to regions of DNA where a cytosine nucleotide occurs next to a guanine nucleotide in the linear sequence of bases along its length. "CpG" is shorthand for "C-phosphate-G", that is, cytosine and guanine separated by only one phosphate; phosphate links any two nucleosides together in DNA. The "CpG" notation is used to distinguish this linear sequence from the CG base-pairing of cytosine and guanine. Cytosines in CpG dinucleotides can be methylated to form 5-methylcytosine. The term "CpG site" or "CpG site of genomic DNA" is also used with respect to the site of a former (unmethylated) CpG site in DNA in which the unmethylated C of the CpG site was converted to another as described herein (e.g. by bisulfite to uracil). The application provides the genomic sequence of each relevant DNA region as well as the bisulfite converted sequences of each converted strand. CpG sites referred to are always the CpG sites of the genomic sequence, even if the converted sequence does no longer contain these CpG sites due to the conversion. The term "hypermethylation" refers to an aberrant methylation pattern or status (i.e. the presence or absence of methylation of one or more nucleotides), wherein one or more nucleotides, preferably C(s) of a CpG site(s), are methylated compared to the same genomic DNA from a non-cancer cell of the patient or a subject not suffering or having suffered from the cancer the patient is treated for, preferably any cancer (healthy control). In particular, it refers to an increased presence of 5-mCyt at one or a plurality of CpG dinucleotides within a DNA sequence of a test DNA sample, relative to the amount of 5-mCyt found at corresponding CpG dinucleotides within a healthy control DNA sample. Hypermethylation as a methylation status/pattern can be determined at one or more CpG site(s). If more than one CpG site is used, hypermethylation can be determined at each site separately or as an average of the CpG sites taken together. Alternatively, all assessed CpG sites must be methylated such that the requirement hypermethylation is fulfilled.

The term "target DNA" as used herein refers to a genomic nucleotide sequence at a specific chromosomal location. In the context of the present invention, it is typically a genetic marker that is known to be hypermethylated in the state of disease (for example in cancer cells vs. non-cancer cells). A genetic marker can be a coding or non-coding region of genomic DNA.

The term "region of the target DNA" as used herein refers to a part of the target DNA which is to be analysed. Generally, the region is at least 50, 60, 70, 80, 90, 100, 150, or 200 or 300 base pairs (bp) long and/or not longer than 500, 600, 700, 800, 900 or 1000 bp (unless limited further as defined herein, e.g. by "less than 100 bp long"). In particular, it is a region comprising at least 3, 4, 5, 6, 7, 8, 9, 10, 11, 12, 13, 14 or 15 CpG sites of the genomic DNA. Preferably, these sites are not covered by a primer used for amplification of the region. Preferably, at least 3, 4, 5, 6, 7, 8, 9, 10, 11, 12, 13, 14 or 15 (but not necessarily all, in particular CpG sites covered by a spacer or methylation-unspecific mismatch, e.g. in a primer) of these CpG sites are methylated in the hypermethylated target DNA.

One target DNA of the invention is genomic DNA associated with SHOX2. The term "SHOX2" as used herein refers to the shox2 (short stature homeobox 2, human NCBI gene ID 6474, genomic location 3q25.32) gene, also designated homeobox protein Og12X or paired-related homeobox protein SHOT. It is a member of the homeobox family of genes that encode proteins containing a 60-amino acid residue motif that represents a DNA-binding domain. Homeobox proteins have been characterized extensively as transcriptional regulators involved in pattern formation in both invertebrate and vertebrate species. The genomic DNA sequence associated with human SHOX2 (chromosome 3 position 158090954-158111503 in GRCh38 genome build) is provided herein (see Table 1).

Another target DNA of the invention is genomic DNA associated with PTGER4. The term "PTGER4" as used herein refers to the ptger4 (prostaglandin E receptor 4, human NCBI gene ID 5734, genomic location 5p13.1) gene, also designated EP4 or EP4R. It is a member of the G-protein coupled receptor family and one of four receptors identified for prostaglandin E2 (PGE2). This receptor can activate T-cell factor signaling, and it has been shown to mediate PGE2 induced expression of early growth response 1 (EGR1), regulate the level and stability of cyclooxygenase-2 mRNA, and lead to the phosphorylation of glycogen synthase kinase-3. Knockout studies in mice suggest that the receptor may be involved in the neonatal adaptation of circulatory system, osteoporosis, as well as initiation of skin immune responses. The genomic DNA sequence associated with human PTGER4 (chromosome 5 position 40674498-40698735 in GRCh38 genome build) is provided herein (SEQ ID NO: 51).

Another target DNA of the invention is genomic DNA associated with FOXL2. The term "FOXL2" as used herein refers to the foxl2 (forkhead box protein L2, human NCBI gene ID 668, genomic location 3q23) gene, also designated BPES, PFRK, POF3, BPES or PINTO.

It is a forkhead transcription factor containing a forkhead DNA-binding domain, and it is involved in development and sex determination. Mutations in the gene are a cause of blepharophimosis syndrome and premature ovarian failure 3. The genomic DNA sequence associated with human FOXL2 (chromosome 3 position 138939224-138952140 in GRCh38 genome build) is provided herein (SEQ ID NO: 1).

The term "sample" as used herein refers to biological material obtained from a subject and comprises genomic DNA from all chromosomes, preferably genomic DNA covering the whole genome. The sample comprises, if a subject has cancer, cells of the cancer or free genomic DNA (including the target DNA) from cancer cells, preferably circulating genomic DNA from cancer cells. It can be derived from any suitable tissue or biological fluid such as blood, saliva, plasma, serum, urine, cerebrospinal liquid (CSF), feces, a buccal or buccal-pharyngeal swab, a surgical specimen, a specimen obtained from a biopsy, or a tissue sample embedded in paraffin. Methods for deriving samples from a subject are well known to those skilled in the art. Preferably, the sample is a tumor biopsy or a liquid sample. The liquid sample is preferably blood, blood serum, blood plasma, or urine. In case the cancer is lung cancer, it is also envisaged that the sample comprises matter derived from bronchoscopy, including bronchial lavage, bronchial alveolar lavage, bronchial brushing or bronchial abrasion, or from sputum or saliva. Typically, in samples comprising the target DNA, especially extracellular target DNA, from cancer cells, there is also target DNA from non-cancer cells which is not hypermethylated contrary to the target DNA from cancer cells. Usually, said target DNA from non-cancer cells exceeds the amount from diseased cells by at least 10-fold, at least 100-fold, at least 1,000-fold or at least 10,000-fold. Generally, the genomic DNA comprised in the sample is at least partially fragmented. "At least partially fragmented" means that at least the extracellular DNA, in particular at least the extracellular target DNA, from cancer cells, is fragmented. The term "fragmented genomic DNA" refers to pieces of DNA of the genome of a cell, in particular a cancer cell, that are the result of a partial physical, chemical and/or biological break-up of the lengthy DNA into discrete fragments of shorter length. Particularly, "fragmented" means fragmentation of at least some of the genomic DNA, preferably the target DNA, into fragments shorter than 1,500 bp, 1,300 bp, 1,100 bp, 1,000 bp, 900 bp, 800 bp, 700 bp, 600 bp, 500 bp, 400 bp, 300 bp, 200 bp or 100 bp. "At least some" in this respect means at least 5%, 10%, 20%, 30%, 40%, 50% or 75%.

The term "genomic DNA" as used herein refers to chromosomal DNA and is used to distinguish from coding DNA. As such, it includes exons, introns as well as regulatory sequences, in particular promoters, belonging to a gene.

The phrase "converting, in DNA, cytosine unmethylated in the 5-position to uracil or another base that does not hybridize to guanine" as used herein refers to a process of chemically treating the DNA in such a way that all or substantially all of the unmethylated cytosine bases are converted to uracil bases, or another base which is dissimilar to cytosine in terms of base pairing behaviour, while the 5-methylcytosine bases remain unchanged. The conversion of unmethylated, but not methylated, cytosine bases within the DNA sample is conducted with a converting agent. The term "converting agent" as used herein relates to a reagent capable of converting an unmethylated cytosine to uracil or to another base that is detectably dissimilar to cytosine in terms of hybridization properties. The converting agent is preferably a bisulfite such as disulfite, or hydrogen sulfite. The reaction is performed according to standard procedures (Frommer et al., 1992, Proc Natl Acad Sci USA 89:1827-31; Olek, 1996, Nucleic Acids Res 24:5064-6; EP 1394172). It is also possible to conduct the conversion enzymatically, e.g. by use of methylation specific cytidine deaminases. Most preferably, the converting agent is sodium bisulfite or bisulfite.

The term "amplifying" or "generating an amplicon" as used herein refers to an increase in the number of copies of the target nucleic acid and its complementary sequence, or particularly a region thereof. The amplification may be performed by using any method known in the art. The amplification of nucleic acid includes methods that require multiple cycles during the amplification process or method that are performed at a single temperature. Cycling techniques are exemplified by methods requiring thermo-cycling. The methods requiring thermo-cycling include polymerase chain reaction (PCR), which is well known in the art. The PCR includes denaturing a double-stranded DNA into single stranded DNAs by thermal denaturation, annealing a primer to the single stranded DNAs; and synthesizing a complementary strand from the primer. Isothermal amplification is an amplification performed at a single temperature or where the major aspect of the amplification process is performed at a single temperature. In the PCR process, the product of the reaction is heated to separate the two strands such that another primer may bind to the template. Conversely, the isothermal techniques rely on a strand displacing polymerase in order to separate the two strands of a double strand and re-copy the template. Isothermal techniques may be classified into methods that rely on the replacement of a primer to initiate a reiterative template copying and those that rely on continued re-use or new synthesis of a single primer molecule. The methods that rely on the replacement of the primer include helicase dependent amplification (HDA), exonuclease dependent amplification, recombinase polymerase amplification (RPA), and loop mediated amplification (LAMP). The methods that rely on continued re-use or new synthesis of a single primer molecule include strand displacement amplification (SDA) or nucleic acid based amplification (NASBA and TMA).

The amplification is preferably performed by methylation-specific PCR (i.e. an amplicon is produced depending on whether one or more CpG sites are converted or not) using primers which are methylation-unspecific, but specific to bisulfite-converted DNA (i.e. hybridize only to converted DNA by covering at least one converted C). Methylation-specificity is achieved by using methylation-specific blocker oligonucleotides, which hybridize to specifically to converted or non-converted CpG sites and thereby terminate the PCR polymerization. In a most preferred embodiment, the step of amplifying comprises a real-time PCR, in particular HeavyMethyl™ or HeavyMethyl™-MethyLight™ The term HeavyMethyl™ as used herein refers to an assay, wherein methylation specific blocking probes (also referred to herein as blockers) covering CpG positions between, or covered by the amplification primers enable methylation-specific selective amplification of the target DNA or a region thereof.

The term "MethyLight™" refers to a high-throughput quantitative methylation assay that utilizes fluorescence-based real-time PCR technology that requires no further manipulations after the PCR step (Eads et al., Cancer Res. 59:2302-2306, 1999, incorporated herein by reference). Briefly, the MethyLight™ process begins with a mixed sample of genomic DNA that is converted, e.g. in a sodium bisulfite reaction, to a mixed pool of methylation-dependent sequence differences according to standard procedures (the bisulfite process converts unmethylated cytosine residues to uracil). Fluorescence-based PCR is then performed in a "biased" (with PCR primers that overlap known CpG dinucleotides) reaction. Sequence discrimination can occur both at the level of the amplification process and at the level of the fluorescence detection process. It may be used as a quantitative test for methylation patterns in the genomic DNA sample, wherein sequence discrimination occurs at the level of probe hybridization. In this quantitative version, the PCR reaction provides for a methylation specific amplification in the presence of a fluorescent probe that overlaps a particular putative methylation site. An unbiased control for the amount of input DNA is provided by a reaction in which neither the primers, nor the probe overlie any CpG dinucleotides. The term "HeavyMethyl™ MethyLight™" assay refers to a HeavyMethyl™ MethyLight™ assay, which is a variation of the MethyLight™ assay, wherein the MethyLight™ assay is combined with methylation specific blocking probes covering CpG positions between the amplification primers.

The term "annealing", when used with respect to an oligonucleotide, is to be understood as a bond of an oligonucleotide to an at least substantially complementary sequence along the lines of the Watson-Crick base pairings in the sample DNA, forming a duplex structure, under moderate or stringent hybridization conditions. When it is used with respect to a single nucleotide or base, it refers to the binding according to Watson-Crick base pairings, e.g. C-G, A-T and A-U. "Substantially complementary" means that an oligonucleotide does not need to reflect the exact sequence of the template and can comprise mismatches and/or spacers as defined herein. Stringent hybridization conditions involve hybridizing at 68° C. in 5×SSC/5×Denhardt's solution/1.0% SDS, and washing in 0.2×SSC/0.1% SDS at room temperature, or involve the art-recognized equivalent thereof (e.g., conditions in which a hybridization is carried out at 60° C. in 2.5×SSC buffer, followed by several washing steps at 37° C. in a low buffer concentration, and remains stable). Moderate conditions involve washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

The term "oligonucleotide" as used herein refers to a linear oligomer of 5 to 50 ribonucleotides or preferably deoxyribonucleotides. Preferably, it has the structure of a single-stranded DNA fragment.

The term "primer oligonucleotide" as used herein refers to a single-stranded oligonucleotide sequence substantially complementary to a nucleic acid sequence sought to be copied (the template) and serves as a starting point for synthesis of a primer extension product. "Substantially complementary" means that a primer oligonucleotide does not need to reflect the exact sequence of the template and can comprise mismatches and/or spacers as defined herein, as long as it is still capable of annealing and serving as a starting point for extension under the chosen annealing and extension conditions (e.g. of a PCR cycle). Preferably, a primer oligonucleotide is 10 to 40 nucleotides, more preferably 15-30 nucleotides and most preferably 19 to 25 nucleotides in length.

The term "blocker" as used herein refers to a molecule which binds in a methylation-specific manner to a single-strand of DNA (i.e. it is specific for either the converted methylated or preferably for the converted unmethylated DNA or the amplified DNA derived from it) and prevents amplification of the DNA by binding to it, for example by preventing a primer to bind or by preventing primer extension where it binds. Non-limiting examples for by blockers are sequence and/or methylation specific antibodies (blocking e.g. primer binding or the polymerase) and in particular blocker oligonucleotides.

A "blocker oligonucleotide" may be a blocker that prevents the extension of the primer located upstream of the blocker oligonucleotide. It comprises nucleosides/nucleotides having a backbone resistant to the 5' nuclease activity of the polymerase. This may be achieved, for example, by comprising peptide nucleic acid (PNA), locked nucleic acid (LNA), Morpholino, glycol nucleic acid (GNA), threose nucleic acid (TNA), bridged nucleic acids (BNA), N3'-P5' phosphoramidate (NP) oligomers, minor groove binder-linked-oligonucleotides (MGB-linked oligonucleotides), phosphorothioate (PS) oligomers, $CrC_4$ alkylphosphonate oligomers, phosphoramidates, j-phosphodiester oligonucleotides, a-phosphodiester oligonucleotides or a combination thereof. Alternatively, it may be a non-extendable oligonucleotide with a binding site on the DNA single-strand that overlaps with the binding site of a primer oligonucleotide. When the blocker is bound, the primer cannot bind and therefore the amplicon is not generated. When the blocker is not bound, the primer-binding site is accessible and the amplicon is generated. For such an overlapping blocker, it is preferable that the affinity of the blocker is higher than the affinity of the primer for the DNA. A blocker oligonucleotide is typically 15 to 50, preferably 20 to 40 and more preferably 25 to 35 nucleotides long. "At least one blocker" refers in particular to a number of 1, 2, 3, 4 or 5 blockers, more particularly to 1-2 or 1-3 blockers. Also, a blocker oligonucleotide cannot by itself act as a primer (i.e. cannot be extended by a polymerase) due to a non-extensible 3' end.

The term "probe oligonucleotide" or "probe" as used herein refers to an oligonucleotide that is used to detect an amplicon by annealing to one strand of the amplicon, usually not where any of the primer oligonucleotides binds (i.e. not to a sequence segment of the one strand which overlaps with a sequence segment a primer oligonucleotide anneals to). Preferably it anneals without a mismatch, in other words it is preferably complementary to one strand of the amplicon. A probe oligonucleotide is preferably 5-40 nucleotides, more preferably 10 to 25 and most preferably 25 to 20 nucleotides long. Usually, the probe is linked, preferably covalently linked, to at least one detectable label which allows detection of the amplicon. The term "detectable label" as used herein does not exhibit any particular limitation. The detectable label may be selected from the group consisting of radioactive labels, luminescent labels, fluorescent dyes, compounds having an enzymatic activity, magnetic labels, antigens, and compounds having a high binding affinity for a detectable label. For example, fluorescent dyes linked to a probe may serve as a detection label, e.g. in a real-time PCR. Suitable radioactive markers are P-32, S-35, 1-125, and H-3, suitable luminescent markers are chemiluminescent compounds, preferably luminol, and suitable fluorescent markers are preferably dansyl chloride, fluorcein-5-isothiocyanate, and 4-fluor-7-nitrobenz-2-aza-1,3 diazole, in particular 6-Carboxyfluorescein (FAM), 6-Hexachlorofluorescein (HEX), 5 (6)-Carboxytetramethyl-rhodamine (TAMRA), 5 (6)-Carboxy-X-Rhodamine (ROX), Cyanin-5-Fluorophor (Cy5) and derivates thereof; suitable enzyme markers are horseradish peroxidase, alkaline phosphatase, a-galactosidase, acetylcholinesterase, or biotin.

The term "covering a CpG site" as used herein with respect to an oligonucleotide refers to the oligonucleotide annealing to a region of DNA comprising this CpG site, before or after conversion of the C of the CpG site (i.e. the CpG site of the corresponding genomic DNA when it is referred to a bisulfite converted sequence). The annealing may, with respect to the CpG site (or former CpG site if the C was converted), be methylation-specific or methylation—unspecific as described below.

The term "methylation-specific" as used herein refers generally to the dependency from the presence or absence of CpG methylation.

The term "methylation-specific" as used herein with respect to an oligonucleotide means that the oligonucleotide does or does not anneal to a single-strand of DNA (in which cytosine unmethylated in the 5-position has been converted to uracil or another base that does not hybridize to guanine, and where it comprises at least one CpG site before conversion) without a mismatch regarding the position of the C in the at least one CpG site, depending on whether the C of the at least one CpG sites was unmethylated or methylated prior to the conversion, i.e. on whether the C has been converted or not. The methylation-specificity can be either positive (the oligonucleotide anneals without said mismatch if the C was not converted) or negative (the oligonucleotide anneals without said mismatch if the C was converted). To prevent annealing of the oligonucleotide contrary to its specificity, it preferably covers at least 2, 3, 4, 5 or 6 and preferably 3 to 6 CpG sites before conversion.

The term "methylation-unspecific" as used herein refers generally to the independency from the presence or absence of CpG methylation.

The term "methylation-unspecific" as used herein with respect to an oligonucleotide means that the oligonucleotide does anneal to a single-strand of DNA (in which cytosine unmethylated in the 5-position has been converted to uracil or another base that does not hybridize to guanine, and where it may or may not comprise at least one CpG site before conversion) irrespective of whether the C of the at least one CpG site was unmethylated or methylated prior to the conversion, i.e. of whether the C has been converted or not. In one case, the region of the single-strand of DNA the oligonucleotide anneals to does not comprise any CpG sites (before and after conversion) and the oligonucleotide is methylation-unspecific solely for this reason. In another case, the region of the single-strand of DNA the oligonucleotide anneals to comprises 1 to 3, i.e. 1, 2 or 3 mismatches and/or spacers, preferably one mismatch or spacer, regarding the position of the C of the CpG site(s) before and after conversion, such that the annealing does not depend on whether the C of the at least one CpG sites was unmethylated or methylated prior to the conversion, i.e. on whether the C has been converted or not. To enable annealing despite mismatches and/or spacers, it is preferred that the oligonucleotide does not comprise more than 1 mismatch per 10 nucleotides (rounded up if the first decimal is 5 or higher, otherwise rounded down) of the oligonucleotide.

The term "mismatch" as used herein refers to base-pair mismatch in DNA, more specifically a base-pair that is unable to form normal base-pairing interactions (i.e., other than "A" with "T" or "U", or "G" with "C").

The term "SNP site" as used herein refers to the site of an "SNP", i.e. a single nucleotide polymorphism at a particular position in the, preferably human, genome that varies among a population of individuals. SNPs of the genomic DNA the present application refers to are known in the art and can be found in online databases such as dbSNP of NCBI (http://www.ncbi.nlm.nih.gov/snp).

The term "SNP-unspecific mismatch" as used herein refers to a mismatch that is due to a nucleotide substitution that does not substitute the nucleotide with one that corresponds to a nucleotide that is found at the same position in the genome of another individual of the same population.

The term "spacer" as used herein refers to a non-nucleotide spacer molecule, which increases, when joining two nucleotides, the distance between the two nucleotides to about the distance of one nucleotide (i.e. the distance the two nucleotides would be apart if they were joined by a third nucleotide). Non-limiting examples for spacers are Inosine, d-Uracil, halogenated bases, Amino-dT, C3, C12, Spacer 9, Spacer 18, and dSpacer) The term "reflects" as used herein is to be understood to mean "is a result of" or "shows".

The phrase "method for detecting the presence or absence of cancer in a subject" as used herein refers to cancer diagnosis of the subject, i.e. a determination whether the subject has cancer or not. As will be understood by persons skilled in the art, such assessment normally may not be correct for 100% of the patients, although it preferably is correct. The term, however, requires that a correct indication can be made for a statistically significant part of the subjects. Whether a part is statistically significant can be determined easily by the person skilled in the art using several well known statistical evaluation tools, for example, determination of confidence intervals, determination of p values, Student's t-test, Mann-Whitney test, etc. Details are provided in Dowdy and Wearden, Statistics for Research, John Wiley & Sons, New York 1983. The preferred confidence intervals are at least 50%, at least 60%, at least 70%, at least 80%, at least 90%, at least 95%. The p values are preferably 0.05, 0.01, or 0.005.

The term "cancer" as used herein refers to a large family of diseases which involve abnormal cell growth with the potential to invade or spread to other parts of the body. The cells form a subset of neoplasms or tumors. A neoplasm or tumor is a group of cells that have undergone unregulated growth, and will often form a mass or lump, but may be distributed diffusely. Preferably, the term "cancer" is defined by one or more of the following characteristics:
  self-sufficiency in growth signalling,
  insensitivity to anti-growth signals,
  evasion of apoptosis,
  enabling of a limitless replicative potential,
  induction and sustainment of angiogenesis, and/or
  activation of metastasis and invasion of tissue.

The cancer with respect to the present invention is preferably selected from the group consisting of Adrenal Cancer, Anal Cancer, Bile Duct Cancer, Bladder Cancer, Bone Cancer, Brain/CNS Tumors, Breast Cancer, Cancer of Unknown Primary, Castleman Disease, Cervical Cancer, Colon/Rectum Cancer, Endometrial Cancer, Esophagus Cancer, Ewing Family Of Tumors, Eye Cancer, Gallbladder Cancer, Gastrointestinal Carcinoid Tumors, Gastrointestinal Stromal Tumor (GIST), Gestational Trophoblastic Disease, Hodgkin Disease, Kaposi Sarcoma, Kidney Cancer, Laryngeal and Hypopharyngeal Cancer, Leukemia, Liver Cancer, Lung Cancer, Lymphoma, Lymphoma of the Skin, Malignant Mesothelioma, Multiple Myeloma, Myelodysplastic Syndrome, Nasal Cavity and Paranasal Sinus Cancer, Nasopharyngeal Cancer, Neuroblastoma, Non-Hodgkin Lymphoma, Oral Cavity and Oropharyngeal Cancer, Osteosarcoma, Ovarian Cancer, Pancreatic Cancer, Penile Cancer, Pituitary Tumors, Prostate Cancer, Retinoblastoma, Rhabdomyosarcoma, Salivary Gland Cancer, Sarcoma—Adult Soft Tissue Cancer, Skin Cancer, Small Intestine Cancer, Stomach Cancer, Testicular Cancer, Thymus Cancer, Thyroid Cancer, Uterine Sarcoma, Vaginal Cancer, Vulvar Cancer, Waldenstrom Macroglobulinemia, and Wilms Tumor.

The term "colorectal cancer" is used in the broadest sense and refers to (1) all stages and all forms of cancer arising from epithelial cells of the large intestine and/or rectum and/or (2) all stages and all forms of cancer affecting the lining of the large intestine and/or rectum. It includes adenocarcinoma, gastrointestinal carcinoid tumor, gastrointestinal stromal tumor, primary colorectal lymphoma, leiomyosarcoma, melanoma or squamous cell carcinoma, each originating from the colon (colon cancer) or the rectum (rectal cancer). In the staging systems used for classification of colorectal cancer, the colon and rectum are treated as one organ.

The term "stage 0 colorectal cancer" as used herein refers to the cancer is in the earliest stage. It has not grown beyond the inner layer (mucosa) of the colon or rectum. This stage is also known as carcinoma in situ or intramucosal carcinoma. Stage 0 corresponds to TisN0M0 of the TNM classification.

The term "stage I colorectal cancer" as used herein refers to the cancer having grown through the muscularis mucosa into the submucosa (T1) or it may also have grown into the muscularis propria (T2). It has not spread to nearby lymph nodes or distant sites. Stage I corresponds to T1-T2N0M0 of the TNM classification.

The term "stage IIA colorectal cancer" as used herein refers to the cancer having grown into the outermost layers of the colon or rectum but has not gone through them (T3). It has not reached nearby organs. It has not yet spread to the nearby lymph nodes or distant sites. Stage IIA corresponds to T3N0M0 of the TNM classification.

The term "stage IIB colorectal cancer" as used herein refers to the cancer having grown through the wall of the colon or rectum but has not grown into other nearby tissues or organs (T4a). It has not yet spread to the nearby lymph nodes or distant sites. Stage IIB corresponds to T4aN0M0 of the TNM classification.

The term "stage IIC colorectal cancer" as used herein refers to the cancer having grown through the wall of the colon or rectum and is attached to or has grown into other nearby tissues or organs (T4b). It has not yet spread to the nearby lymph nodes or distant sites. Stage IIC corresponds to T4bN0M0 of the TNM classification.

The term "stage IIIA colorectal cancer" as used herein refers to one of the following: (i) The cancer has grown through the mucosa into the submucosa (T1) and it may also have grown into the muscularis propria (T2). It has spread to 1 to 3 nearby lymph nodes (N1a/N1b) or into areas of fat near the lymph nodes but not the nodes themselves (N1c). It has not spread to distant sites. This corresponds to T1-T2N1M0 of the TNM classification. (ii) The cancer has grown through the mucosa into the submucosa (T1). It has spread to 4 to 6 nearby lymph nodes (N2a). It has not spread to distant sites. This corresponds to T1N2aM0 of the TNM classification.

The term "stage IIIB colorectal cancer" as used herein refers to one of the following: (i) The cancer has grown into the outermost layers of the colon or rectum (T3) or through the visceral peritoneum (T4a) but has not reached nearby organs. It has spread to 1 to 3 nearby lymph nodes (N1a/N1b) or into areas of fat near the lymph nodes but not the nodes themselves (N1c). It has not spread to distant sites. This corresponds to T3-T4aN1M0 of the TNM classification. (ii) The cancer has grown into the muscularis propria (T2) or into the outermost layers of the colon or rectum (T3). It has spread to 4 to 6 nearby lymph nodes (N2a). It has not spread to distant sites. This corresponds to T2-T3N2aM0 of the TNM classification. (iii) The cancer has grown through the mucosa into the submucosa (T1) or it may also have grown into the muscularis propria (T2). It has spread to 7 or more nearby lymph nodes (N2b). It has not spread to distant sites. This corresponds to T1-T2N2bM0 of the TNM classification.

The term "stage IIIC colorectal cancer" as used herein refers to one of the following: (i) The cancer has grown through the wall of the colon or rectum (including the visceral peritoneum) but has not reached nearby organs (T4a). It has spread to 4 to 6 nearby lymph nodes (N2a). It has not spread to distant sites. This corresponds to T4aN2aM0 of the TNM classification. (ii) The cancer has grown into the outermost layers of the colon or rectum (T3) or through the visceral peritoneum (T4a) but has not reached nearby organs. It has spread to 7 or more nearby lymph nodes (N2b). It has not spread to distant sites. This corresponds to T3-T4aN2bM0 of the TNM classification. (iii) The cancer has grown through the wall of the colon or rectum and is attached to or has grown into other nearby tissues or organs (T4b). It has spread to at least one nearby lymph node or into areas of fat near the lymph nodes (N1 or N2). It has not spread to distant sites. This corresponds to T4bN1-N2M0 of the TNM classification.

The term "stage IVA colorectal cancer" as used herein refers to the cancer having or not having grown through the wall of the colon or rectum, and having or not having spread to nearby lymph nodes. It has spread to 1 distant organ (such as the liver or lung) or set of lymph nodes (M1a). This corresponds to anyTanyNM1a of the TNM classification.

The term "stage IVA colorectal cancer" as used herein refers to the cancer having or not having grown through the wall of the colon or rectum, and having or not having spread to nearby lymph nodes. It has spread to more than 1 distant organ (such as the liver or lung) or set of lymph nodes, or it has spread to distant parts of the peritoneum (the lining of the abdominal cavity) (M1b). This corresponds to anyTanyNM1b of the TNM classification.

The term "lung cancer" includes small cell lung cancer (SCLC) and non-small cell lung cancer (NSCLC).

The term "SCLC" or "small cell lung cancer", as used herein, refers to an undifferentiated neoplasm, preferably composed of primitive- or embryonic-appearing cells.

As the name implies, the cells in small-cell carcinomas are smaller than normal cells and barely have room for any cytoplasm.

The term "NSCLC" or "non-small cell lung cancer", as used herein, refers to a group of heterogeneous diseases grouped together because their prognosis and management is roughly identical and includes, according to the histological classification of the World Health Organization/International Association for the Study of Lung Cancer (Travis W D et al. Histological typing of lung and pleural tumors. $3^{rd}$ ed. Berlin: Springer-Verlag, 1999):

(i) Squamous cell carcinoma (SCC), accounting for 30% to 40% of NSCLC, starts in the larger breathing tubes but grows slower meaning that the size of these tumors varies on diagnosis.

(ii) Adenocarcinoma is the most common subtype of NSCLC, accounting for 50% to 60% of NSCLC, which starts near the gas-exchanging surface of the lung and which includes a subtype, the bronchioalveolar carcinoma, which may have different responses to treatment.

(iii) Large cell carcinoma is a fast-growing form that grows near the surface of the lung. It is primarily a diagnosis of exclusion, and when more investigation is done, it is usually reclassified to squamous cell carcinoma or adenocarcinoma.

(iv) Adenosquamous carcinoma is a type of cancer that contains two types of cells: squamous cells (thin, flat cells that line certain organs) and gland-like cells.

(v) Carcinomas with pleomorphic, sarcomatoid or sarcomatous elements. This is a group of rare tumors reflecting a continuum in histological heterogeneity as well as epithelial and mesenchymal differentiation.

(vi) Carcinoid tumor is a slow-growing neuroendocrine lung tumor and begins in cells that are capable of releasing a hormone in response to a stimulus provided by the nervous system.

(vii) Carcinomas of salivary gland type begin in salivary gland cells located inside the large airways of the lung.

(viii) Unclassified carcinomas include cancers that do not fit into any of the aforementioned lung cancer categories.

The NSCLC may be a squamous cell carcinoma, adenocarcinoma, large cell (undifferentiated) carcinoma, adenosquamous carcinoma and sarcomatoid carcinoma.

The SCLC or NSCLC may be a stage 0, IA, IB, IIa, IIb, IIIa, IIIb or IV NSCLC.

The term "stage 0 NSCLC", as used herein, refers to a tumor which is present only in the top layers of cells lining the air passages. It has not invaded deeper into other lung tissues and has not spread to lymph nodes or distant sites. Stage 0 corresponds to stages TisN0M0 of the TNM classification.

The term "stage I NSCLC" or "stage I SCLC", as used herein, refers to tumor which is present in the lungs but the cancer has not been found in the chest lymph nodes or in other locations outside of the chest. Stage I (N)SCLC is subdivided into stages IA and IB, usually based upon the size of the tumor or involvement of the pleura, which is lining along the outside of the lung. In Stage IA, the tumor is 3 centimeters (cm) or less in size and has invaded nearby tissue minimally, if at all. The cancer has not spread to the lymph nodes or to any distant sites. In Stage IB, the tumor is more than 3 cm in size, has invaded the pleural lining around the lung, or has caused a portion of the lung to collapse. The cancer has not spread to the lymph nodes or to any distant sites. Stage IA corresponds to stages T1N0M0 of the TNM classification. Stage IB corresponds to T2M0N0 of the TNM classification.

The term "Stage II NSCLC" or "stage I SCLC", as used herein, refers to a cancer which has either begun to involve the lymph nodes within the chest or has invaded chest structures and tissue more extensively. However, no spread can be found beyond the involved side of the chest, and the cancer is still considered a local disease. Stage II is subdivided into stages IIA and IIB. Stage IIA refers to tumors which are 3 cm or smaller and have invaded nearby tissue minimally, if at all. One or more lymph nodes on the same side of the chest are involved, but there is no spread to distant sites. Stage IIB is assigned in two situations: when there is a tumor larger than 3 cm with some invasion of nearby tissue and involvement of one or more lymph nodes on the same side of the chest; or for cancers that have no lymph node involvement, but have either invaded chest structures outside the lung or are located within 2 cm of the carina (the point at which the trachea, or the tube that carries air to the lungs, splits to reach the right and left lungs). Stage IIA corresponds to T1N1M0 or T2N1M0 of the TNM classification. Stage IIB corresponds to T3N0M0 according to the TNM classification.

The term "Stage III NSCLC" or "stage I SCLC", as used herein, refers to tumors which have invaded the tissues in the chest more extensively than in stage II, and/or the cancer has spread to lymph nodes in the mediastinum. However, spread (metastasis) to other parts of the body is not detectable. Stage III is divided into stages IIIA and IIIB. Stage IIIA refers to a single tumor or mass that is not invading any adjacent organs and involves one or more lymph nodes away from the tumor, but not outside the chest. Stage IIIB refers to a cancer which has spread to more than one area in the chest, but not outside the chest. Stage IIIA corresponds to T1N2M0, T2N2M0, T3N1M0, T3N2M0, T4N0M0 or T4N1M0 according to the TNM classification. Stage IIIB corresponds to T1N3M0, T2N3M0, T3N3M0, T4N2M0 or T4N3M0 according to the TNM classification.

The term "Stage IV NSCLC" or "stage I SCLC", as used herein, refers to a cancer which has spread, or metastasized, to different sites in the body, which may include the liver, brain or other organs. Stage IV corresponds to any T or any N with M1.

The TNM classification is a staging system for malignant cancer. As used herein the term "TNM classification" refers to the $6^{th}$ edition of the TNM stage grouping as defined in Sobin et al. (International Union Against Cancer (UICC), TNM Classification of Malignant tumors, $6^{th}$ ed. New York; Springer, 2002, pp. 191-203) (TNM6) and AJCC Cancer Staging Manual 6th edition; Chapter 19; Lung—original pages 167-177 whereby the tumors are classified by several factors, namely, T for tumor, N for nodes, M for metastasis as follows:

T: Primary tumor cannot be assessed, or tumor proven by the presence of malignant cells in sputum or bronchial washings but not visualized by imaging or bronchoscopy:

T0: No evidence of primary tumor,

Tis: Carcinoma in situ,

T1: Tumor 3 cm or less in greatest dimension, surrounded by lung or visceral pleura, without bronchoscopic evidence of invasion more proximal than the lobar bronchus (for example, not in the main bronchus), T2: Tumor more than 3 cm but 7 cm or less or tumor with any of the following features (T2 tumors with these features are classified T2a if 5 cm or less): involves main bronchus, 2 cm or more distal to the carina; invades visceral pleura (PL1 or PL2); associated with atelectasis or obstructive pneumonitis that extends to the hilar region but does not involve the entire lung, T3: Tumor more than 7 cm or one that directly invades any of the following: parietal pleural (PL3), chest wall (including superior sulcus tumors), diaphragm, phrenic nerve, mediastinal pleura, parietal pericardium; or tumor in the main bronchus less than 2 cm distal to the carina but without involvement of the carina; or associated atelectasis or obstructive pneumonitis of the entire lung or separate tumor nodule(s) in the same lobe and T4: Tumor of any size that invades any of the following: mediastinum, heart, great vessels, trachea, recurrent laryngeal nerve, esophagus, vertebral body, carina, separate tumor nodule(s) in a different ipsilateral lobe.

N (Regional Lymph Nodes):
 NX: Regional lymph nodes cannot be assessed
 N0: No regional lymph node metastases
 N1: Metastasis in ipsilateral peribronchial and/or ipsilateral hilar lymph nodes and intrapulmonary nodes, including involvement by direct extension
 N2: Metastasis in ipsilateral mediastinal and/or subcarinal lymph node(s)
 N3: Metastasis in contralateral mediastinal, contralateral hilar, ipsilateral or contralateral scalene, or supraclavicular lymph node(s)
M: Distant Metastasis
 M0: No distant metastasis
 M1: Distant metastasis The term "cancer cell" as used herein refers to a cell that acquires a characteristic set of functional capabilities during their development, particularly one or more of the following: the ability to evade apoptosis, self-sufficiency in growth signals, insensitivity to anti-growth signals, tissue invasion/metastasis, significant growth potential, and/or sustained angiogenesis. The term is meant to encompass both pre-malignant and malignant cancer cells.

The term "tumor DNA" or "tumor DNA of a cancer cell" as used herein refers simply to DNA of a cancer cell. It is used only to distinguish DNA of a cancer cell more clearly from other DNA referred to herein. Thus, unless ambiguities are introduced, the term "DNA of a cancer cell" may be used instead.

The term "subject" as used herein refers to an individual, such as a human, a non-human primate (e.g. chimpanzees and other apes and monkey species); farm animals, such as birds, fish, cattle, sheep, pigs, goats and horses; domestic mammals, such as dogs and cats; laboratory animals including rodents, such as mice, rats and guinea pigs. The term does not denote a particular age or sex. In a particular meaning, the subject is a mammal. In a preferred meaning, the subject is a human.

The term "is indicative for" or "indicates" as used herein refers to an act of identifying or specifying the thing to be indicated. As will be understood by persons skilled in the art, such assessment normally may not be correct for 100% of the patients, although it preferably is correct. The term, however, requires that a correct indication can be made for a statistically significant part of the subjects. Whether a part is statistically significant can be determined easily by the person skilled in the art using several well known statistical evaluation tools, for example, determination of confidence intervals, determination of p values, Student's t-test, Mann-Whitney test, etc. Details are provided in Dowdy and Wearden, Statistics for Research, John Wiley & Sons, New York 1983. The preferred confidence intervals are at least 50%, at least 60%, at least 70%, at least 80%, at least 90%, at least 95%. The p values are preferably 0.05, 0.01, or 0.005.

The term "generating an amplicon" as used herein refers to amplifying a defined region of a double-stranded or single-stranded DNA template, typically with a polymerase chain reaction (PCR). An "amplicon" is a double-stranded fragment of DNA according to said defined region.

The term "pair of primers" as used herein refers to two oligonucleotides, namely a forward and a reverse primer, that have, with respect to a double-stranded nucleic acid molecule, sequences that are (at least substantially) identical to one strand each such that they each anneal to the complementary strand of the strand they are (at least substantially) identical to. The term "forward primer" refers to the primer which is (at least substantially) identical to the forward strand (as defined by the direction of the genomic reference sequence) of the double-stranded nucleic acid molecule, and the term "reverse primer" refers to the primer which is (at least substantially) identical to the reverse complementary strand of the forward strand in the double-stranded nucleic acid molecule. The distance between the sites where forward and reverse primer anneal to their template depends on the length of the amplicon the primers are supposed to allow generating. Typically, with respect to the present invention it is between 50 and 1000 bp. Preferred amplicon sizes are specified herein. In case of single-stranded DNA template that is to be amplified using a pair of primers, only one of the primers anneals to the single strand in the first amplification cycle. The other primer then binds to the newly generated complementary strand such that the result of amplification is a double-stranded DNA fragment. The phrase "pair of primers suitable for generating an amplicon from a single strand of genomic DNA in which cytosine unmethylated in the 5-position has been converted to uracil or another base that does not hybridize to guanine" refers to a pair of primers which takes into account a base change from unmethylated cytosines to uracil, which basepairs with adenine and is therefore replaced with thymine in the amplicon.

The term "treatment" or "treating" with respect to cancer as used herein refers to a therapeutic treatment, wherein the goal is to reduce progression of cancer. Beneficial or desired clinical results include, but are not limited to, release of symptoms, reduction of the length of the disease, stabilized pathological state (specifically not deteriorated), slowing down of the disease's progression, improving the pathological state and/or remission (both partial and total), preferably detectable. A successful treatment does not necessarily mean cure, but it can also mean a prolonged survival, compared to the expected survival if the treatment is not applied. In a preferred embodiment, the treatment is a first line treatment, i.e. the cancer was not treated previously. Cancer treatment involves a treatment regimen.

The term "treatment regimen" as used herein refers to how the patient is treated in view of the disease and available procedures and medication. Non-limiting examples of cancer treatment regimes are chemotherapy, surgery and/or irradiation or combinations thereof. The early detection of cancer the present invention enables allows in particular for a surgical treatment, especially for a curative resection. In particular, the term "treatment regimen" refers to administering one or more anti-cancer agents or therapies as defined below. A change in the treatment regimen does not necessarily mean a change of the drugs or therapy, but may also mean a change of the dose of the same drug or therapy. The term "anti-cancer agent or therapy" as used herein refers to chemical, physical or biological agents or therapies, or surgery, including combinations thereof, with antiproliferative, antioncogenic and/or carcinostatic properties.

A chemical anti-cancer agent or therapy may be selected from the group consisting of alkylating agents, antimetabolites, plant alkaloids and terpenoids and topoisomerase inhibitors. Preferably, the alkylating agents are platinum-based compounds. In one embodiment, the platinum-based compounds are selected from the group consisting of cisplatin, oxaliplatin, eptaplatin, lobaplatin, nedaplatin, carboplatin, iproplatin, tetraplatin, lobaplatin, DCP, PLD-147, JM1 18, JM216, JM335, and satraplatin.

A physical anti-cancer agent or therapy may be selected from the group consisting of radiation therapy (e.g. curative radiotherapy, adjuvant radiotherapy, palliative radiotherapy, teleradiotherapy, brachytherapy or metabolic radiotherapy), phototherapy (using, e.g. hematoporphoryn or photofrin II), and hyperthermia.

Surgery may be a curative resection, palliative surgery, preventive surgery or cytoreductive surgery. Typically, it involves an excision, e.g. intracapsular excision, marginal, extensive excision or radical excision as described in Baron and Valin (Rec. Med. Vet, Special Canc. 1990; 11(166):999-1007).

A biological anti-cancer agent or therapy may be selected from the group consisting of antibodies (e.g. antibodies stimulating an immune response destroying cancer cells such as retuximab or alemtuzumab, antibodies stimulating an immune response by binding to receptors of immune cells an inhibiting signals that prevent the immune cell to attack "own" cells, such as ipilimumab, antibodies interfering with the action of proteins necessary for tumor growth such as bevacizumab, cetuximab or panitumumab, or antibodies conjugated to a drug, preferably a cell-killing substance like a toxin, chemotherapeutic or radioactive molecule, such as Y-ibritumomab tiuxetan, I-tositumomab or ado-trastuzumab emtansine), cytokines (e.g. interferons or interleukins such as INF-alpha and IL-2), vaccines (e.g. vaccines comprising cancer-associated antigens, such as sipuleucel-T), oncolytic viruses (e.g. naturally oncolytic viruses such as reovirus, Newcastle disease virus or mumps virus, or viruses genetically engineered viruses such as measles virus, adenovirus, vaccinia virus or herpes virus preferentially targeting cells carrying cancer-associated antigens such as EGFR or HER-2), gene therapy agents (e.g. DNA or RNA replacing an altered tumor suppressor, blocking the expression of an oncogene, improving a patient's immune system, making cancer cells more sensitive to chemotherapy, radiotherapy or other treatments, inducing cellular suicide or conferring an anti-angiogenic effect) and adoptive T cells (e.g. patient-harvested tumor-invading T-cells selected for antitumor activity, or patient-harvested T-cells genetically modified to recognize a cancer-associated antigen).

In one embodiment, the one or more anti-cancer drugs is/are selected from the group consisting of Abiraterone Acetate, ABVD, ABVE, ABVE-PC, AC, AC-T, ADE, Ado-Trastuzumab Emtansine, Afatinib Dimaleate, Aldesleukin, Alemtuzumab, Aminolevulinic Acid, Anastrozole, Aprepitant, Arsenic Trioxide, Asparaginase Erwinia chrysanthemi, Axitinib, Azacitidine, BEACOPP, Belinostat, Bendamustine Hydrochloride, BEP, Bevacizumab, Bexarotene, Bicalutamide, Bleomycin, Bortezomib, Bosutinib, Brentuximab Vedotin, Busulfan, Cabazitaxel, Cabozantinib-S-Malate, CAFCapecitabine, CAPOX, Carboplatin, CARBOPLATIN-TAXOL, Carfilzomib, Carmustine, Carmustine Implant, Ceritinib, Cetuximab, Chlorambucil, CHLORAMBUCIL-PREDNISONE, CHOP, Cisplatin, Clofarabine, CMF, COPP, COPP-ABV, Crizotinib, CVP, Cyclophosphamide, Cytarabine, Cytarabine, Liposomal, Dabrafenib, Dacarbazine, Dactinomycin, Dasatinib, Daunorubicin Hydrochloride, Decitabine, Degarelix, Denileukin Diftitox, Denosumab, Dexrazoxane Hydrochloride, Docetaxel, Doxorubicin Hydrochloride, Doxorubicin Hydrochloride Liposome, Eltrombopag Olamine, Enzalutamide, Epirubicin Hydrochloride, EPOCH, Eribulin Mesylate, Erlotinib Hydrochloride, Etoposide Phosphate, Everolimus, Exemestane, FEC, Filgrastim, Fludarabine Phosphate, Fluorouracil, FU-LV, Fulvestrant, Gefitinib, Gemcitabine Hydrochloride, GEMCITABINE-CISPLATIN, GEMCITABINE-OXALIPLATIN, Gemtuzumab Ozogamicin, Glucarpidase, Goserelin Acetate, HPV Bivalent Vaccine, Recombinant HPV Quadrivalent Vaccine, Hyper-CVAD, Ibritumomab Tiuxetan, Ibrutinib, ICE, Idelalisib, Ifosfamide, Imatinib, Mesylate, Imiquimod, Iodine 131 Tositumomab and Tositumomab, Ipilimumab, Irinotecan Hydrochloride, Ixabepilone, Lapatinib Ditosylate, Lenalidomide, Letrozole, Leucovorin Calcium, Leuprolide Acetate, Liposomal Cytarabine, Lomustine, Mechlorethamine Hydrochloride, Megestrol Acetate, Mercaptopurine, Mesna, Methotrexate, Mitomycin C, Mitoxantrone Hydrochloride, MOPP, Nelarabine, Nilotinib, Obinutuzumab, Ofatumumab, Omacetaxine Mepesuccinate, OEPA, OFF, OPPA, Oxaliplatin, Paclitaxel, Paclitaxel Albumin-stabilized Nanoparticle Formulation, PAD, Palifermin, Palonosetron Hydrochloride, Pamidronate Disodium, Panitumumab, Pazopanib Hydrochloride, Pegaspargase, Peginterferon Alfa-2b, Pembrolizumab, Pemetrexed Disodium, Pertuzumab, Plerixafor, Pomalidomide, Ponatinib Hydrochloride, Pralatrexate, Prednisone, Procarbazine Hydrochloride, Radium 223 Dichloride, Raloxifene Hydrochloride, Ramucirumab, Rasburicase, R-CHOP, R-CVP, Recombinant HPV Bivalent Vaccine, Recombinant HPV Quadrivalent Vaccine, Recombinant Interferon Alfa-2b, Regorafenib, Rituximab, Romidepsin, Romiplostim, Ruxolitinib Phosphate, Siltuximab, Sipuleucel-T, Sorafenib Tosylate, STANFORD V, Sunitinib Malate, TAC, Talc, Tamoxifen Citrate, Temozolomide, Temsirolimus, Thalidomide, Topotecan Hydrochloride, Toremifene, Tositumomab and I 131 Iodine Tositumomab, TPF, Trametinib, Trastuzumab, Vandetanib, VAMP, VeIP, Vemurafenib, Vinblastine Sulfate, Vincristine Sulfate, Vincristine Sulfate Liposome, Vinorelbine Tartrate, Vismodegib, Vorinostat, XELOX, Ziv-Aflibercept, and Zoledronic Acid.

SEQ IDs Referred to in the Application

The present application refers to SEQ ID NOs 1-151. An overview and explanation of these SEQ IDs is given in the following Table 1:

TABLE 1

| SEQ IDs of the specification. r.c. means reverse complement, C to T or G to A means converted by bisulfite conversion of cytosines outside of CpG context into uracil and replaced by thymidine in subsequent amplification, bis1 refers to the bisulfite converted forward strand (as recited in the SEQ ID of the respective genomic DNA) and bis2 to the bisulfite converted reverse complement strand of the forward strand(reverse complement of the SEQ ID of the respective genomic DNA), whereby the direction of the strand is defined by the direction of the genomic reference sequence as e.g. obtained from the genome build (HCGR38). For a mapping of the sequences, see FIG. 2. | |
|---|---|
| FOXL2gene associated region 3: 138939224-138952140 | |
| SEQ ID NO: 1 | genomic reference |
| SEQ ID NO: 2 | C to T (bis1) |
| SEQ ID NO: 3 | rc C to T (bis1) |
| SEQ ID NO: 4 | G to A (bis2 rc) |
| SEQ ID NO: 5 | G to A (bis2 rc) rc |
| FOXL2gene 3: 138944224-138947140 | |
| SEQ ID NO: 6 | genomic reference |
| SEQ ID NO: 7 | C to T (bis1) |
| SEQ ID NO: 8 | rc C to T (bis1) |
| SEQ ID NO: 9 | G to A (bis2 rc) |
| SEQ ID NO: 10 | G to A (bis2 rc) rc |
| FOXL2Extended Assay regions 3: 138938957-138940572 | |
| SEQ ID NO: 11 | genomic reference |
| SEQ ID NO: 12 | C to T (bis1) |
| SEQ ID NO: 13 | rc C to T (bis1) |
| SEQ ID NO: 14 | G to A (bis2 rc) |
| SEQ ID NO: 15 | G to A (bis2 rc) rc |

TABLE 1-continued

SEQ IDs of the specification. r.c. means reverse complement,
C to T or G to A means converted by bisulfite conversion of cytosines
outside of CpG context into uracil and replaced by thymidine
in subsequent amplification, bis1 refers to the bisulfite converted
forward strand (as recited in the SEQ ID of the respective genomic
DNA) and bis2 to the bisulfite converted reverse complement strand
of the forward strand(reverse complement of the SEQ ID of the
respective genomic DNA), whereby the direction of the strand
is defined by the direction of the genomic reference sequence
as e.g. obtained from the genome build (HCGR38). For a mapping
of the sequences, see FIG. 2.

| FOXL2Extended Assay1 3: 138939501-138940572 | |
|---|---|
| SEQ ID NO: 16 | genomic reference |
| SEQ ID NO: 17 | C to T (bis1) |
| SEQ ID NO: 18 | rc C to T (bis1) |
| SEQ ID NO: 19 | G to A (bis2 rc) |
| SEQ ID NO: 20 | G to A (bis2 rc) rc |
| FOXL2Extended Assay2 3: 138938957-138940027 | |
| SEQ ID NO: 21 | genomic reference |
| SEQ ID NO: 22 | C to T (bis1) |
| SEQ ID NO: 23 | rc C to T (bis1) |
| SEQ ID NO: 24 | G to A (bis2 rc) |
| SEQ ID NO: 25 | G to A (bis2 rc) rc |
| FOXL2Extended Assay3 3: 138939170-138940237 | |
| SEQ ID NO: 26 | genomic reference |
| SEQ ID NO: 27 | C to T (bis1) |
| SEQ ID NO: 28 | rc C to T (bis1) |
| SEQ ID NO: 29 | G to A (bis2 rc) |
| SEQ ID NO: 30 | G to A (bis2 rc) rc |
| FOXL2Assay Regions 3: 138939457-138940072 | |
| SEQ ID NO: 31 | genomic reference |
| SEQ ID NO: 32 | C to T (bis1) |
| SEQ ID NO: 33 | rc C to T (bis1) |
| SEQ ID NO: 34 | G to A (bis2 rc) |
| SEQ ID NO: 35 | G to A (bis2 rc) rc |
| FOXL2Assay1 3: 138940001-138940072 | |
| SEQ ID NO: 36 | genomic reference |
| SEQ ID NO: 37 | C to T (bis1) |
| SEQ ID NO: 38 | rc C to T (bis1) |
| SEQ ID NO: 39 | G to A (bis2 rc) |
| SEQ ID NO: 40 | G to A (bis2 rc) rc |
| FOXL2Assay2 3: 138939457-138939527 | |
| SEQ ID NO: 41 | genomic reference |
| SEQ ID NO: 42 | C to T (bis1) |
| SEQ ID NO: 43 | rc C to T (bis1) |
| SEQ ID NO: 44 | G to A (bis2 rc) |
| SEQ ID NO: 45 | G to A (bis2 rc) rc |
| FOXL2Assay3 3: 138939670-138939737 | |
| SEQ ID NO: 46 | genomic reference |
| SEQ ID NO: 47 | C to T (bis1) |
| SEQ ID NO: 48 | rc C to T (bis1) |
| SEQ ID NO: 49 | G to A (bis2 rc) |
| SEQ ID NO: 50 | G to A (bis2 rc) rc |
| PTGER4gene associated region 5: 40674498-40698735 | |
| SEQ ID NO: 51 | genomic reference |
| SEQ ID NO: 52 | C to T (bis1) |
| SEQ ID NO: 53 | rc C to T (bis1) |
| SEQ ID NO: 54 | G to A (bis2 rc) |
| SEQ ID NO: 55 | G to A (bis2 rc) rc |
| PTGER4gene 5: 40679498-40693735 | |
| SEQ ID NO: 56 | genomic reference |
| SEQ ID NO: 57 | C to T (bis1) |
| SEQ ID NO: 58 | rc C to T (bis1) |
| SEQ ID NO: 59 | G to A (bis2 rc) |
| SEQ ID NO: 60 | G to A (bis2 rc) rc |
| PTGER4Extended Assay regions 5: 40680481-40682501 | |
| SEQ ID NO: 61 | genomic reference |
| SEQ ID NO: 62 | C to T (bis1) |
| SEQ ID NO: 63 | rc C to T (bis1) |
| SEQ ID NO: 64 | G to A (bis2 rc) |
| SEQ ID NO: 65 | G to A (bis2 rc) rc |
| PTGER4Extended Assay1 5: 40681221-40682316 | |
| SEQ ID NO: 66 | genomic reference |
| SEQ ID NO: 67 | C to T (bis1) |
| SEQ ID NO: 68 | rc C to T (bis1) |
| SEQ ID NO: 69 | G to A (bis2 rc) |
| SEQ ID NO: 70 | G to A (bis2 rc) rc |
| PTGER4Extended Assay2 5: 40680481-40681563 | |
| SEQ ID NO: 71 | genomic reference |
| SEQ ID NO: 72 | C to T (bis1) |
| SEQ ID NO: 73 | rc C to T (bis1) |
| SEQ ID NO: 74 | G to A (bis2 rc) |
| SEQ ID NO: 75 | G to A (bis2 rc) rc |
| PTGER4Extended Assay3 5: 40681436-40682501 | |
| SEQ ID NO: 76 | genomic reference |
| SEQ ID NO: 77 | C to T (bis1) |
| SEQ ID NO: 78 | rc C to T (bis1) |
| SEQ ID NO: 79 | G to A (bis2 rc) |
| SEQ ID NO: 80 | G to A (bis2 rc) rc |
| PTGER4Assay Regions 5: 40680981-40682001 | |
| SEQ ID NO: 81 | genomic reference |
| SEQ ID NO: 82 | C to T (bis1) |
| SEQ ID NO: 83 | rc C to T (bis1) |
| SEQ ID NO: 84 | G to A (bis2 rc) |
| SEQ ID NO: 85 | G to A (bis2 rc) rc |
| PTGER4Assay1 5: 40681721-40681816 | |
| SEQ ID NO: 86 | genomic reference |
| SEQ ID NO: 87 | C to T (bis1) |
| SEQ ID NO: 88 | rc C to T (bis1) |
| SEQ ID NO: 89 | G to A (bis2 rc) |
| SEQ ID NO: 90 | G to A (bis2 rc) rc |
| PTGER4Assay2 5: 40680981-40681063 | |
| SEQ ID NO: 91 | genomic reference |
| SEQ ID NO: 92 | C to T (bis1) |
| SEQ ID NO: 93 | rc C to T (bis1) |
| SEQ ID NO: 94 | G to A (bis2 rc) |
| SEQ ID NO: 95 | G to A (bis2 rc) rc |
| PTGER4Assay3 5: 40681936-40682001 | |
| SEQ ID NO: 96 | genomic reference |
| SEQ ID NO: 97 | C to T (bis1) |
| SEQ ID NO: 98 | rc C to T (bis1) |
| SEQ ID NO: 99 | G to A (bis2 rc) |
| SEQ ID NO: 100 | G to A (bis2 rc) rc |
| SHOX2gene associated region 3: 158090954-158111503 | |
| SEQ ID NO: 101 | genomic reference |
| SEQ ID NO: 102 | C to T (bis1) |
| SEQ ID NO: 103 | rc C to T (bis1) |
| SEQ ID NO: 104 | G to A (bis2 rc) |
| SEQ ID NO: 105 | G to A (bis2 rc) rc |
| SHOX2gene 3: 158095954-158106503 | |
| SEQ ID NO: 106 | genomic reference |
| SEQ ID NO: 107 | C to T (bis1) |
| SEQ ID NO: 108 | rc C to T (bis1) |
| SEQ ID NO: 109 | G to A (bis2 rc) |
| SEQ ID NO: 110 | G to A (bis2 rc) rc |

TABLE 1-continued

SEQ IDs of the specification. r.c. means reverse complement,
C to T or G to A means converted by bisulfite conversion of cytosines
outside of CpG context into uracil and replaced by thymidine
in subsequent amplification, bis1 refers to the bisulfite converted
forward strand (as recited in the SEQ ID of the respective genomic
DNA) and bis2 to the bisulfite converted reverse complement strand
of the forward strand(reverse complement of the SEQ ID of the
respective genomic DNA), whereby the direction of the strand
is defined by the direction of the genomic reference sequence
as e.g. obtained from the genome build (HCGR38). For a mapping
of the sequences, see FIG. 2.

| SHOX2Extended Assay 3: 158103050-158104140 | |
|---|---|
| SEQ ID NO: 111 | genomic reference |
| SEQ ID NO: 112 | C to T (bis1) |
| SEQ ID NO: 113 | rc C to T (bis1) |
| SEQ ID NO: 114 | G to A (bis2 rc) |
| SEQ ID NO: 115 | G to A (bis2 rc) rc |
| SHOX2Assay 3: 158103550-158103640 | |
| SEQ ID NO: 116 | genomic reference |
| SEQ ID NO: 117 | C to T (bis1) |
| SEQ ID NO: 118 | rc C to T (bis1) |
| SEQ ID NO: 119 | G to A (bis2 rc) |
| SEQ ID NO: 120 | G to A (bis2 rc) rc |
| SEQ ID NO: 121 | SHOX2-F |
| SEQ ID NO: 122 | SHOX2-R4 |
| SEQ ID NO: 123 | SHOX2-FB5 |
| SEQ ID NO: 124 | SHOX2-RB4 |
| SEQ ID NO: 125 | SHOX2-Taq-DABCYL |
| SEQ ID NO: 126 | LC01__17389.51 |
| SEQ ID NO: 127 | LC03__17389.53Rml |
| SEQ ID NO: 128 | LC05__17389.5B2 |
| SEQ ID NO: 129 | C06__17389.5taq2HEXTQ |
| SEQ ID NO: 130 | LC83__FXLR1B1F2 |
| SEQ ID NO: 131 | LC74__FXLR1B1R2 |
| SEQ ID NO: 132 | LC__105__FXLR1B1B1 |
| SEQ ID NO: 133 | LC__106__FXLR1B1B2 |
| SEQ ID NO: 134 | LC__107__FXLR1B1P1 |
| SEQ ID NO: 135 | LC94__FXLR4B2F1 |
| SEQ ID NO: 136 | LC97__FXLR4B2R2 |
| SEQ ID NO: 137 | LC__102__FXLR4B2B1 |
| SEQ ID NO: 138 | LC__103__FXLR4B2B2 |
| SEQ ID NO: 139 | LC__104__FXLR4B2P1 |
| SEQ ID NO: 140 | LC07__74983.4f2 |
| SEQ ID NO: 141 | LC08__74983.4r2 |
| SEQ ID NO: 142 | LC09__74983.4B6 |
| SEQ ID NO: 143 | LC10__74983.4taq5 |
| SEQ ID NO: 144 | LC15__PTGR4R2B1F1 |
| SEQ ID NO: 145 | LC17__PTGR4R2B1R2 |
| SEQ ID NO: 146 | LC58__PTGR4R2B1B2 |
| SEQ ID NO: 147 | LC71__PTGR4R2B1P1 |
| SEQ ID NO: 148 | LC35__PTGR4R7B2F3 |
| SEQ ID NO: 149 | LC37__PTGR4R7B2R2 |
| SEQ ID NO: 150 | LC59__PTGR4R7B2B1 |
| SEQ ID NO: 151 | LC72__PTGR4R7B2P1 |

The invention is described by way of the following examples which are to be construed as merely illustrative and not limitative of the scope of the invention.

Example 1

Sample Preparation:

Technical samples used for assessing the assay were prepared as mixtures of bisulfite treated PBL (peripheral blood DNA) DNA known to be unmethylated in the assay region (Human Genomic DNA: Male, Promega GmbH) and methylated DNA (DNA treated with DNA-Methyltransferases—Universal Methylated DNA, Merck Chemicals GmbH) in 10 ng/ml total. As a second technical reference control for unmethylated DNA genome wide randomly amplified DNA (Phi) was used. Genomic DNA controls were untreated PBL DNA. All other DNAs used or mixed for technical controls were bisulfite treated with the EpiTect Bisulfite Kit (Qiagen GmbH) following the manufacturers protocol before dilution and mixing. In technical samples, the genomic DNA was not fragmented/degraded as opposed to circulating tumor DNA.

Plasma controls were prepared by spiking 3.5 ml bulk plasma from healthy (non-cancer) patients (Plasma, Normal EDTA, Cliniqa Co.) with methylated DNA (DNA treated with DNA-Methyltransferases—Universal Methylated DNA, Merck Chemicals GmbH). Patient plasma samples were 3-3.5 ml leftovers from lung cancer and healthy (non-cancer) patients in cancer studies. Lung cancer DNA is plasma is fragmented/degraded.

Sample/DNA Processing:

Technical samples/DNA mixtures were used directly. Plasma samples were processed analogous to the pre-analytic workflow as defined in the instructions for use (IFU) of the Epi proColon 2.0 kit (Epigenomics AG).

PCR reactions either used 10 ng total DNA in each reaction for technical samples or the processed equivalent of about 1 ml plasma for plasma samples. Except for the PCR mix containing the relevant oligomers as laid out for the assays in this application, the realtime PCR on a LightCycler 480 (Roche Applied Sciences) was done following the PCR protocols of the Epi proColon 2.0 PCR kit (Epigenomics AG).

This example compares two assays for FOXL2 covering and assessing the identical CpGs with their blockers and probes: 1. An established 90 bp long HM assay (FOXL2-long; see FIG. 3A) without mismatches in the middle the primers, which has been chosen from a variety of alternatives of assays of such size and characteristics and has been optimized regarding primer/blocker/probe sequences in many experiments. 2. A new 68 bp long HM assay (FOXL2-short; see FIG. 3B) with a methylation unspecific mismatch in the middle of one primer. This assay has not yet been optimized regarding primer/blocker/probe sequences.

Results:

The assays were compared on technical samples and on spiked plasma samples—both comparisons giving clear evidence that the shorter assay was surprisingly performing better than the longer assay though it was not optimized and had a mismatch right in the middle of one of the primers. This was surprising not only because the shortening improved sensitivity greatly, but also because the effect does not depend on DNA fragmentation which is a hallmark of circulating tumor DNA (in the technical samples, the DNA was not fragmented).

The results for the shorter assay were verified in independent experiments on technical and spiked plasma samples (FIG. 3A). The amount of measurable methylated DNA was repeatedly shown to be as low as 10 pg methylated DNA per PCR (technical samples) or 12 pg methylated DNA per PCR (spiked plasma samples) which is the equivalent of about 4 molecules of template (with 6 pg DNA being about the mass of one cell's diploid genome).

Figure 3B:
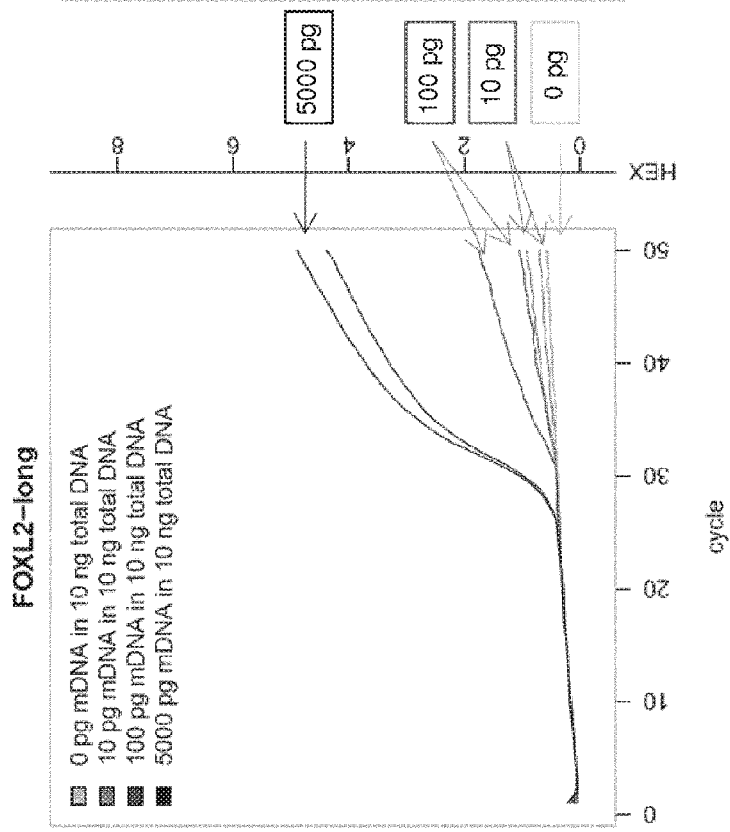
Figures 5A, 5B:
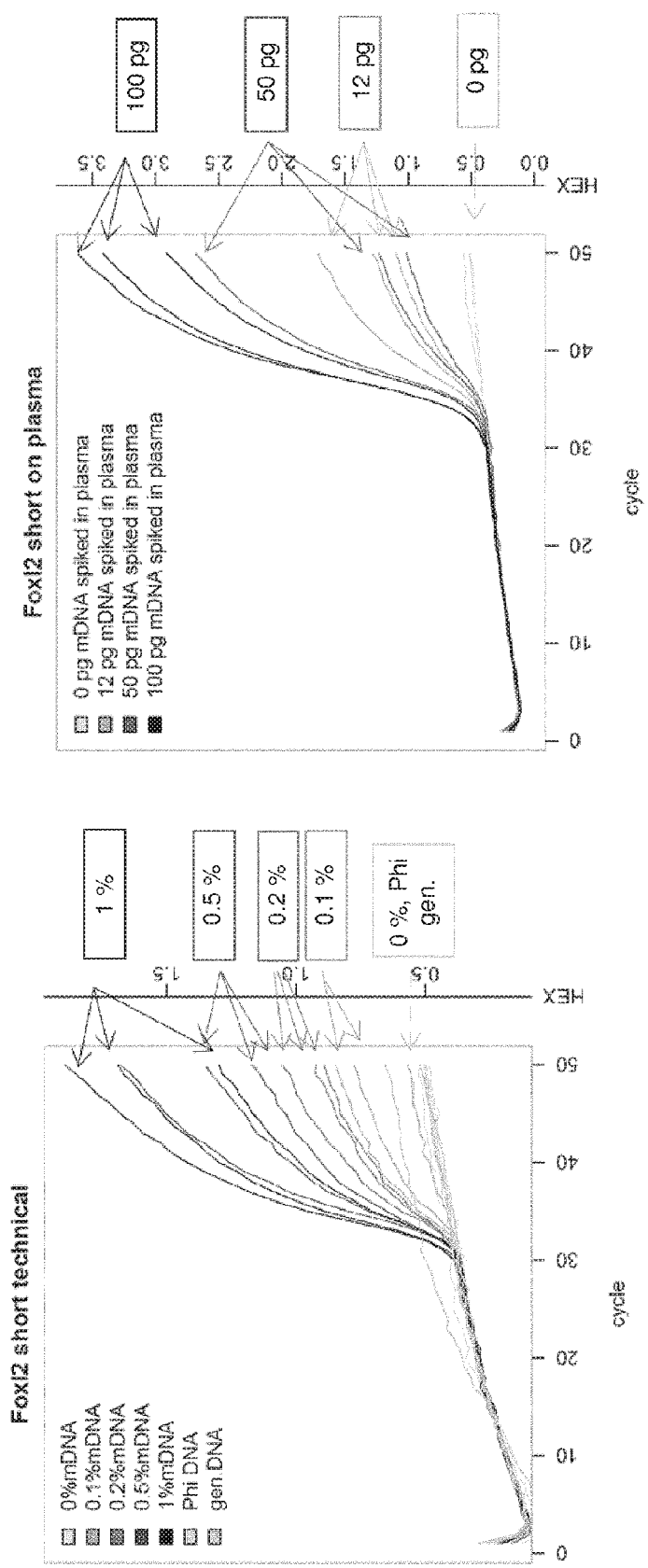

The limited amount of patient plasma material prohibited a head to head comparison of the two assays and was used with the technically better performing short assay only to verify its usability for detecting FOXL2 methylation in cancer patients in blood plasma (FIG. 3B).

Example 2

Sample Preparation and Processing:

Blood plasma samples from lung cancer patients, patients with benign lung diseases and healthy controls were collected as defined in the instructions for use (IFU) of the Epi proColon 2.0 kit (Epigenomics AG). Briefly, for EDTA plasma was prepared by two centrifugation steps. Until processing plasma samples were stored at −70° C. For the lung cancer cases, blood draws were performed prior to any cancer specific treatment. All subjects were in a similar age range.

Plasma samples were processed analogous to the pre-analytic workflow as defined in the instructions for use (IFU) of the Epi proColon 2.0 kit (Epigenomics AG). PCR reactions were performed as technical duplicates or triplicates using the processed equivalent of about 1 ml plasma in a total volume of 30 al. Real time PCR on Applied Biosystems 7500 Fast Dx (Applied Biosystems) was done following the PCR protocols of the Epi proColon 2.0 PCR kit (Epigenomics AG). Beside methylation status of the investigated markers, ACTB level was measured as reference in parallel. All investigated samples were defined as valid for analysis based on their ACTB value. For data and ROC analyses, the minimal Ct value of the technical replicates were used.

Study 1:

In a first study, SHOX2 methylation was assessed in a duplex reaction with ACTB as reference comparing lung cancer cases with healthy controls. PCR reactions were performed as technical duplicates using 12 µl bisulfite treated DNA from Epi proColon elution as template in a total volume of 30 µl. 59 samples from lung cancer cases were investigated. 26 cases were diagnosed with squamous lung cancer, 22 cases with adenocarcinoma, 5 cases with SCLC, 3 cases with other than NSCLC, 2 cases with adenosquamous and 1 case with large-cell carcinoma. 92 plasma samples from individuals with no evidence of disease were processed as controls.

Study 2:

In a second study, SHOX2 methylation was assessed in a triplex reaction with another methylation marker and ACTB as reference comparing lung cancer cases with healthy controls. PCR reactions were performed as technical quadruplicates using 12 µl bisulfite treated DNA from Epi proColon elution as template in a total volume of 30 µl. 48 samples from lung cancer cases were investigated. 26 cases were diagnosed with squamous lung cancer, 20 cases with adenocarcinoma, 1 case with other than NSCLC 1 case with large-cell carcinoma. 100 plasma samples from individuals with no evidence of disease were processed as controls.

Study 3:

In a third study, the status of SHOX2 methylation was investigated in other lung diseases than cancer and compared to SHOX2 methylation in lung cancer patients. SHOX2 methylation was assessed in a triplex reaction with another methylation marker and ACTB as reference. PCR reactions were performed as technical triplicates using 15 µl bisulfite treated DNA from Epi proColon elution as template in a total volume of 30 µl. In this study, a subset of the 50 investigated plasma samples from lung cancer patients used in study I and study II was compared to 50 controls. These controls were diagnosed with different lung diseases: 18 cases with chronic obstructive pulmonary disease (COPD), 10 cases with pneumonia, 5 cases with asthma, 5 cases with bronchiectasis, and 12 cases with other lung diseases e.g. echinococcus infection or osteochondromatosis.

Figure 6:
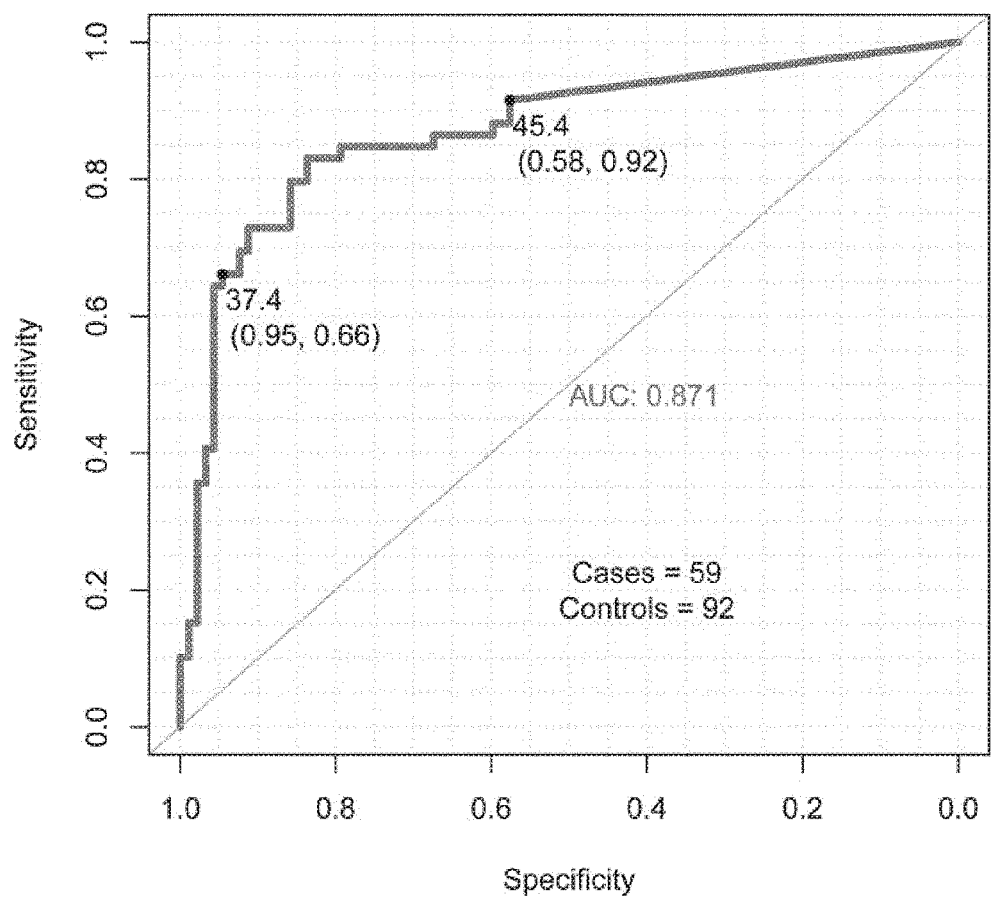
FIG. 6: SHOX2 methylation in blood plasma samples from lung cancer patients in comparison to blood plasma controls from healthy individuals assessed by real time PCR in a duplex reaction with ACTB as reference. 59 samples from lung cancer patients and 92 healthy controls were compared. Calculated AUC=0.871. Marked points are thresholds for 95% sensitivity resp. 95% specificity.

Results:

The detection of SHOX2 methylation in blood plasma in previous studies resulted in a clinical performance with an area under the curve value of 0.78 in a ROC plot comparing 288 lung cancer patients and 189 controls (Kneip et al., Journal of Thoracic Oncology, Volume 6, Number 8, August 2011). In that study, a SHOX2 assay of a 124 bp long amplicon was used to distinguish between lung cancer patients and healthy subjects. The modification of the assay, as described here, uses modified oligonucleotides allowing a mismatch in the primer resulting in a shorter, 91 bp long amplicon (see also FIG. 2, SHOX2). The assay of Kneip et al. and the assay described herein detect methylation at the same CpG sites. This modification of the inventor's assay resulted in an unexpectedly improved detection of SHOX2 and better clinical performance. This is demonstrated by the three separate studies:

Study I used the inventor's new 91 bp SHOX2 assay comprising a primer mismatch (FIG. 2) in a duplex reaction with ACTB as a reference gene. Here, the comparison of 59 blood plasma samples from lung cancer patients and 92 blood plasma samples from healthy individuals as controls resulted in an improved AUC of 0.871 in the ROC curve analysis (FIG. 6).

In the second study, the level of SHOX2 methylation was investigated by comparing 48 blood plasma samples from lung cancer patients and 100 blood plasma samples from healthy individuals as controls, using the same 91 bp SHOX2 assay comprising a primer mismatch. In contrast to study I, SHOX2 was measured in a triplex reaction measuring in addition to ACTB a further methylation marker. Despite an increased complexity of the assay, the clinical performance is still improved as evidences by the AUC of 0.893 in the ROC plot (FIG. 7).

In the third study, it was investigated if SHOX2 methylation found in blood plasma is characteristic for lung cancer or might be correlated to other lung cancer diseases than cancer. Therefore, a subset of 50 blood plasma samples from lung cancer patients from study I and study II was measured again and compared to 50 blood plasma samples from patients with benign lung diseases. Again, the same 91 bp SHOX2 assay comprising a primer mismatch was used. ROC analysis, resulting in an AUC of 0.834 (FIG. 8), showed that detection of SHOX2 methylation with the shorter modified assay, as described here, can be used to distinguish not only from healthy controls but also from patients with benign lung diseases.

In summary, all three studies showed that the inventor's 91 bp SHOX2 assay comprising a primer mismatch as shown in FIG. 2 is surprisingly superior in a clinical assessment to a longer assay without a mismatch, although both assays rely on the same CpG sites.

SEQUENCE LISTING (151 sequences)

SEQ ID NO: 1 - DNA, 12917 bp, Homo sapiens
aaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaaccgggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaaacgtgtgaagaccgctttgggggaagcgagagggaggttggaggagccccgggcggggtctcagcgcccaccagctgtgccttcagggcttgggtgttcgctgcaacggcaaccgcgtgagcctcactcccacggccaaggggctagggcagggtggatgcaatcgcgtgcgcctggccccggaaggtgctcgcagggggtgcctgtggccagctgggttaggaagtcaaatcctagaaagttattactaaaggttttttttcccccttcctttcttctttccttttttgcttccttccttccttttttttttttaataggggaagggaaaaaacattattgaacatctactataaactgggcacttaaaaattagaaaatttaattattttaataattctgatacacgcacgtatttctgttttatagaggagaacactgaaatttgaatgggtattttgcccaaggttacatagctgttaaagaggacaccaggctccaacccagttcttcctgactaaacaggccaggtctttgcctcatgctgcacaggccacctccgcgaagtgacaagatcccagaacatgcttttcacagctcagcaccaagcctgtgcggcaaacagcctgtgcagcagcagtttctgtggtacagaaacaaacaaaaaaggcaaaaggcacagctcagactgtgcttccttcttctcctgggaggctctcccttactactcctgggaggctctcccttactacgcagctcccttgagcatcagtggcagctaggctcagctgctgtcaagtctcctttaaaaatttcggaggccatttgcctcacagatacctggaagacctctggttggtctcttctcttcttaggacctgagattcctcaaatgtaatgtaattttgggttcctagacccaagacactctttttatgacagctgggagtcctctctccagaaagtggaaagttgctaagactgctcggttttaagaatccttaattcctggttgtcccgaaggcatggggctcttagtcccatcctttccccatcttttctatgggtcccacagtctactccaagaagtaggggctgccacacagtggtggtaggcctgacgggcagggccccagggtcaccaccaggttagatctgcagaatggggacactgcagggatgctgagcctgatcaagatgtttcctggccttagacccccacccagaagccaggagtctggtccggtgatcctgtccatgaagcctggcccagaccttcataaagggaagagctcagttgagagcaaactatcttgggccagactcagattcctggcccatattctgcttgtctggctgcatgaagcctgggtctggccccaatttccacccgccgccagggggctccttgcagccccatctccagccttggcttccaggaaaccctggcaaaggctggatgcacctaacctcggatgaaaggtccagggcctcttgctcatctaagcctcagatctggagcagtgaactatttactgatgcaagctggaaacaggacgtcaataccctctggagtagggtacaggaccatctccagaactccgtaggtccctttcccacagtcccttggtgcatgtacttcaatggcgaagatttctccaggtccctcttgagaacaggacacctccccctgctttctccaaaccaacccacttactctgactgggcaattttagtgaggtggaggtgactctaagaatttctgtgtaaatgtgaggagagggctcatactgtcagcagtgtgtgagatgtttacacccaccacacacataatcttcatgcaagaacgactcattacccaggacattcagaaattggctgggtatttgtattaaactctatttacattgtatttacacactggccaatatatatacacacactcacatggcccagccatctaggccagactgtatatgctaaggcataattgctatataactcaaatacttttgccctcaggaattgcttaaatcagcttctataatagaaactcaaaagtgcgaagagggagagaagagaaaggaaatgagagatgaagaaagcctgccattgaactaaactttcggccctggggaaaatgaccaaacttaagagctttggagaaatcccgagggctggagttagacagatttttcctgtgggcatccatggggaagtggggtatgatttggctcccttctctcacctccttcaatccctgtgtagacccaggaaaccctcactgattgcttcattttgtcttccttacttggtgaggctgctgctctcttcccagccttgggtgccttttgcctttcagttctcggggaggagacaggctggtccttcattgctggccccggccaacttctccgtctcactggaggtgggctgctacctgcccaccagggcttggtcctggaagcttccctcccttgctttctctgcttgagacggcagttgggggagtgctgacagccagcttcagaacagggagcctctgcctgatgaagcaaaggctctgtccatattactttatttttcagcaagccaggaatacacacccacaaatgcacacatcaccaatgaggtatgaatgccacacacactgtggtcccagtaagcacttcctaagtgttagccatatgattattacaatgccaaaaatatatgcccactctgcaggcgaatgacagacacacacacctcccaccctgtcaccaatacacaactgacactgtacacacacatttgcagcagatacagactacacaattacttgcccatgggctaaattttcacgctagacaaagcacaaacagacatgcacacagcaggctgctttctgttctgcaactccccttagccagatagtggagcagccgggcaccaaaggcacccagacaccaggcctgaccagcctctagggcttcctgctccagctgagcctccctctccatcctgctcctgccggttcctggtaagctccagtcccagtcttgaggtgatgccccctgagaatccccgtggcttggtctcctgccttgtagcctctcgcaggatgcctgtggggggcggggggcattctgagcagaagccacttgggcccaactatacataacaggataccaccctgaggttcctaccgcctgaccactggagggctgaagtgagaggcctgcaggctcattcccgtggcgcaaaaccgctcctggcccaccagccggcctggacctgccgccacattgctggccaggccccgagatagacggggggggggcagtgagggctgggtgcggggtctagtctcagctgagcagcagcccgcaagaaccggcggatctatcctatcagaagtcggaagtcatctatcccatcagaagagtgaaagccgaccaccccctaatccgcctgggagaaccagactgcaaccaggtcaaacgcctgtgtgcctgcgcggaagcatggatcttaattcgttatttggggatctcagtaaaggaagagagagaaagaaaaaagactaaatttctgcagccgcgaagtatgttcaatccttactgaaacctccaaatctcctacccatatctcaaggtaaatgaattctgactattaaaaataataaagcagtcacttctcacatttgtacagaggttagcagtttgcagcgcatttccacaaccagaattttatctattaatgtttggaacaaactcttggctgttatagttgactcaaaatcgaaaagtttgagaacaataataaaaacacagccagcccatacacctagtacaactgtgtatgaggtagaatacaaacttgaataggtacaaaaataaaccaagtcctacctacagtcgcgccttgtgaacgaaccacggcagaaaaagtctttctgctgacgttaaacagccgcaacgggccagtgatgacacagaaaacaaacaatcccaggaaaacaaagcagcagcgacagccacaaacgcctgccaccccggttgctctcaatctttgtttaactcattctgaaaaagataaaattttgctgaaaatcttcctcttttaactagctgctgaactaaggagcgacagaaataaagaagtccgtgttaaaagaaggaacacaaaatttattcgggaatcgacaaggcaaaaaacaaaaacaaaacaaaaaaacacaacaaaagtgctctagttctctctagaaaatttggtcccccaaacaacaagctacagtacaaccaggtctatggttttcgggccgggccggctccgggccacaagaccgcctaggtcggccgctgccgggtttcacatttctccttcccaaggtgggagaagcaggaggtttgaaaaacaaaaagcagggaggacgagccgtcccagcagcgtgggccaggcaggcagtgatctccctgcctccaggacttgcatcgaaagatccggggacatttgtttttgatttttttcttcagatagggagagggtgaaacttccccaattggtagacgaaaccatcttttattggatatattctcctaactctgaacacagctttttgaaggcccaacaaaaactctaacgcaaatcttccagaagagaagatgaggaatactaaagcttttgattttcatatttggatttagcaaactccaaggccacaatacttccccggttgcccggtgaattttttttcctttttttttttttaaatactctcttaaaaagttccaccgatctttcaaacaaaacattagccagccgccggggcccggaggtgcccgaagcgacgggactgatagcggaggaaacgcagcctccctccgcgcccgcccgcggtgtaaaccgagtacaggccgtggagccaggctgccccggctcccgctgggtcccaacccccgccccgcctagtgggccccgcggcaagcggcttctgaacagcttcaagagggttcgcggagcaaacacacgtattggtccgtccctttctcgggcagcgcggtcccgccatcagtcctgtccggcgcgtctagccatggactgcacggcagtcgggcggggaacgcggagagcgagcgcaccgacctgtgagagaaggccaagaggtctgcgctgccgacgcccggtcgcacctccgccccgggccctttccgcggtgaatttgggcaggagacgctggggctccggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgtcgcgcgtccctgcatcctcgcatccgtctgcaccggcatgcggtgggctctcagagatcgaggcgcgaatgcagcgcgccggtcttgctgtcgtggtcccagtaagagcaatgcatcatggcgagctcgggctgccgggcacaagcgaactgcaggcccggcgcactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggggtgcggccggcgggcctcccaggccattgtacgagttcactacgccggggggcagcgccatgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacagcgtgagcctcttctccgcgctctcgcggatcgccatggcgatgagcgccacgtacgagtacgggggcttctgcgccgggtccggcttctccggggctgtcccgccgccacccccaccgcccttgcctgggctcggcggcggcccttctggctccttgactgtgcgaccggtctctggggccagcagggcccccgccgcgtcctcgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccgtcttgaggctgaacttctagctcggggctggggaggggcgagacggcgagggggctggacggggtagggtggggagagctgctctgaggctttgggaaagtcagcccagaaacgggtgtgactgtacgaagaagcctcggcctggcctgtccctcgcgctctcagagtgactgggctggaatggggcaggggagaggatctctggaaatagtcgtcaggggcgccgcctgaatcacctctgcctctccctgcgttaccagtggatctaggaaccaggaatccgtgtactaatcctacggggttggagtgaaggttggatgtgtgctttaacagcaccaagtagatgcccctcagctattgcactaacacaggcggggctgttgcccgggactttgcgggactgtgtatgtgtgtgcacaggggtcacatatggaagtcatggagaggagctgtccttgagatgggtgagataccaggtgcatgtgtgctgctcagaaacacaggtatgcacatgtacaaggtgtgagatttgtatttacgaggtaaaacacacttatactgatagttatgtaatatgttcatcaagtattagagtaaatgtagctggtggatatagcatcttctctttttctcctttcttacttctttccttcccccctttcttcctttctttcacaattcttcgatgcctctttccctcccagtgtatgtattttgccacagactgggaagacaaacatcaggctgagggagggacttgttcaaatctctctcctgatgagacatttgttctgatctttctccaaagaatcaggagttagttgtcacctaccttaagcagaattctgatgggaatccaattatttcagcatgtacagagattgtttcagggaaaatcaggtgtgccttttaacagtgtgctccttaacagtgccttttaacttggcctaaacaaaaagtctgcagtcataaagtatgagagagatggccagtgttttgaatcctcaagccccaaactccttggtgctgaggaggggggcaaggccaccttatggaggaaggtggactgaatggatgtcatatagctgtgcattagtgattggcatgtctggagtggctgactcaatgcctgtcactgcctcttcctcccaggctgtttagactctgagggttctcctgaagcccaaggagccttcagcggcctgtggttccagcatccacaggccatctacaagtgttgtctgctgctcactcaggcctctgatctgcattctgagatgaaagggagggaggacaagggtggtagggctctttggaattcagcatcttgaagatgacaccagagaggtcagcagggcagcccttgcctggtcacaaggatgagagggagcaaggctatccccaaagtagcttggttttttttatgggcggtctcccactgcacccaacagacatgggggaagcagcacttccgcagaatccctgctgctgctttctgagcaggagtgcagatgtttttcttcttccttacccccatccttgcccaagctttgggtgggagtggtgagtccggtttggggctgctgcagattggcctcagtgcctatcctcccccagccagggcctgggcagggggaaaaacagctgggtctggccccatcctggtgggggctcctctctccttttctctcctttttttttttcttgaccacccaggctggctctctgcgtctctctgtctttctttcttcttctcacaggcatttccgctgctcagccctgcagcagccaggtgtaacagcattgttgtgtgtgtcatcacttccctgaattccacactcggctcccttttcagcctttaaagagcctgtgtgtgtatgcatgtgcgtgtgtgtgtgtgtgtgtgtgtgtgtaggggttgggggcaaatgaaggagttcctctgaaggattttcagaatagaaaggagttctgctctgaaaatactgatttctgactgtcccgtagaggaacagaatccccagccctggtgaagaagaggatgcctgatgcgtgcaccctgggaagggctggaatcggtctccccaagatgtgccttcacatggctgtccggcattcgaaggctcagaaaacaggcaagaaaatgcgggcgggaaagctggcagaatgattactttcaggtcccctccaggcttctgcggaaaagccaggggcttcgggctggagatagaggaatctagggagagaacagaatcctctccttgccggcccagccagaggtgggtgaaccgggcgctccaggaaacggtgcggggcgccctgatttacttctcaaccttcggaggtaggctggttgctggcgaggtcgggatcctctctgaacagggcatactgtgcctaggttttgtggacgccagggccggttccttttctccccgcggcattggggcgacgcagggcccccggcttagtgaccttggggcggcgctcacctccaaaggccagggtggtgggctgggcagaactcactgcctctttgccccagttttccagggtcccgcagctgcaattcagcagccaccggcgcctcctgaccgtggtcccaccgtagcgccgcctgcggatacggttccagtgaaccgccgattgagcgcagtctcagctcccgcgcctcctcgcagcctggccccgcgcctcggaggtcccgacagccggcgcgagcaatctacacggctctgatacagacgcttttctccccagggccgggaatcctgcaacagcggcagaagccgcccgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagagcttgctgcaaccctctgcttggagggatggcctctgcggtgcttggctagcaaagggaagcttcactgtgtctattagtacatccccatacactccacgcctcaacaactgtcagcactcactccctcccggcccctcacagggccctttgcacccacacctcagggactcggtgtccctccactcaggtcacgttactccatccacttctctctccttctccctctgtcaactccaaatcccctctagttctccctcccctcctacttctctcacactcaccagctacacgtactaattcagattttgcacatgttggtggaaaacatgtcaagccaatgtgcagaccctaaggcttttcacacgctgctcactttcgcatctcacggtgcagaaggaccaatgggctccaggtttacaagcctgactccgagaagcctgttgattctctgatgtccttggcctgtgattcgggtgactgggctgccacctgggtgttttcatgatgggactgccgcacagaccacagagaagctcaggtactgagcacgttccagatacactttaacatgcacaggccactcacacaggctttatctctgtctcgaaactctgctgagtttgctgctcagaccaacaaggtgcagcagcagacacccacatagcaccaggtctgaagccagtgggtattagtctgcctggttgggattagcaaagtcagttactcacatatgtgcttgggagagaataggggagtggagagagagagagagatattgaggaagaggaaagagaagcgacctcctactctgggaagaactcacacatgagagctgtttcctgttgttaagtgtctcactgagctcccctctttctcccccaggaagggcttgagaggcagtagaccagagctctgggctcctctttaccttgctgatgttggggtatgagtcctccaacaccattttgtcccaaggagtatgtgccccatcgtcaatcaggcagaatgcagggcagttgtcggcctttttcatggtggaggccaactgggaaaaaggcagaagggtctgggtcctgggccaagtgaggccctcttccctccaaagacccgtgggatgctctcagaggcggattctagggtggtgggagctgctgacaagtttcctctgatatccctcatgacatctatggcccaaagccattttgttcagctctgaacagtgagtgccttgccagtaggcctcaggcttgctggggaacatgatgtgttcttaaaagttgccttgttgcctttctccacacccagactgtaagcgctgatgggcagagactctgccctccacttctcactcagtgctccccaccaggatgggcttaatgccttttaatagaattagaaaatggttctgctggacagaattgggaaatgccactttccttataatgaagttataatgaagttagaatttccaagaaagggactgtagctgaggaaaagcggtttgatcattgacagccagctcaggatctgagagttctttgccatttggggttattatagctgcatggccatggtgctgaaccttaggcaagggcaaggacacctccctagttcccagtcatggtgaggacctgtctgaaacatt

SEQ ID NO: 2 - DNA, 12917 bp, Artificial Sequence
  bisulfite converted genomic DNA
aaaaatatgtgtcgaatttttttttttttttttttagaaataaataaataaaaaaggtaaaaggcgaatttttttttatttttcgtttatagagattaaagttttttgggattttgttttttttttttttttgattgtttagaaatatttgtttttttttgtatatagaggaaaatgcggggaaaggttttttaaaattcggttttatattattattattattaaggataatcgggtaggttgaggttttaacgtggatgattcgagttggtttcgcgtcggggttttgtagttattgttttgtgcgtttagtatttttgggggcgattagggtttttgcgttttcgttcgtcgttcggtagtcgagagtattttgtgtttagattggtcgatttattttttttcgaattttgtttagagttggtaagggggatttagttcgcgttttaagatttgggtttgtagcgtcgttaataggttcggggatacgaggcgttttaggtcggggttttttcggttgttggtttttttcgttttttattcgttggcggcgtttcggtcgttcgtaattgatttaattcgttttttgcgtttgttttttaggtttttcgtttttttataaaggtttaggggagtttcgtttataggttgattttgtaatttttggttcggtggttattttttgtttttttgaaaaagaaaaggaaaaaaaaaaaaaaaaagaaaaaattaattagtcgagggaggcgcgtgaggattggaggcgttagtcggatagtttatgagtaggtttttgggtcggtgtcgtttcgcgggttagtacggttttttttagagaaaattttttaaacgtgtgaagatcgttttgggggaagcgagagggaggttggaggagtttcgggcggggttttagcgtttattagttgtgtttttagggtttgggtgttcgttgtaacggtaatcgcgtgagttttatttttacggttaaggggttagggtagggtggatgtaatcgcgtgcgtttggtttcggaaggtgttcgtagggggtgtttgtggttagttgggttaggaagttaaattttagaaagttattattaaaggtttttttttttttttttttttttttttttttttttgtttttttttttttttttttttttttaataggggaagggaaaaaatattattgaatatttattataaattgggtatttaaaaattagaaaatttaattattttaataattttgatatacgtacgtatttttgttttatagaggagaatattgaaatttgaatgggtattttgtttaaggttatatagttgttaaagaggatattaggttttaatttagttttttttgattaaataggttaggtttttgttttatgttgtataggttattttcgcgaagtgataagattttagaatatgttttttatagtttagtattaagtttgtgcggtaaatagtttgtgtagtagtagtttttgtggtatagaaataaataaaaaaggtaaaaggtatagtttagattgtgtttttttttttttttgggaggtttttttttattatttttgggaggtttttttttattacgtagtttttttgagtattagtggtagttaggtttagttgttgttaagttttttttaaaaatttcggaggttatttgttttatagatatttggaagatttttggttggttttttttttttttaggatttgagattttttaaatgtaatgtaattttgggtttttagatttaagatattttttttatgatagttgggagttttttttttagaaagtggaaagttgttaagattgttcggttttaagaatttttaatttttggttgtttcgaaggtatggggtttttagttttattttttttttattttttttatgggttttatagtttattttaagaagtaggggttgttatatagtggtggtaggtttgacgggtagggttttagggttattattaggttagatttgtagaatggggatattgtagggatgttgagtttgattaagatgttttttggttttagatttttatttagaagttaggagtttggttcggtgattttgtttatgaagtttggtttagatttttataaagggaagagtttagttgagagtaaattattttgggttagatttagatttttggtttatattttgtttgtttggttgtatgaagtttgggtttggttttaatttttattcgtcgttagggggttttttgtagttttatttttagttttggtttttaggaaattttggtaaaggttggatgtatttaatttcggatgaaaggtttagggttttttgtttatttaagttttagatttggagtagtgaattatttattgatgtaagttggaaataggacgttaatattttttggagtagggtataggattatttttagaatttcgtaggttttttttttatagttttttggtgtatgtattttaatggcgaagatttttttaggttttttttgagaataggatatttttttttgttttttttaaattaatttatttattttgattgggtaattttagtgaggtggaggtgattttaagaatttttgtgtaaatgtgaggagagggtttatattgttagtagtgtgtgagatgtttatatttattatatatataatttttatgtaagaacgatttattatttaggatatttagaaattggttgggtatttgtattaaattttatttatattgtatttatatattggttaatatatatatatatatttatatggtttagttatttaggttagattgtatatgttaaggtataattgttatataatttaaatatttttgtttttaggaattgtttaaattagtttttataatagaaatttaaaagtgcgaagagggagagaagagaaaggaaatgagagatgaagaaagtttgttattgaattaaattttcggttttggggaaaatgattaaatttaagagttttggagaaatttcgagggttggagttagatagattttttttgtgggtatttatggggaagtggggtatgatttggttttttttttttattttttttaatttttgtgtagatttaggaaatttttattgattgttttattttgttttttttatttggtgaggttgttgttttttttttagttttgggtgttttttgttttttagttttcggggaggagataggttggttttttattgttggtttcggttaattttttcgttttattggaggtgggttgttatttgtttattagggtttggttttggaagttttttttttttgttttttttgtttgagacggtagttgggggagtgttgatagttagttttagaatagggagtttttgtttgatgaagtaaaggttttgtttatattattttattttttagtaagttaggaatatatatttataaatgtatatattattaatgaggtatgaatgttatatatattgtggttttagtaagtattttttaagtgttagttatatgattattataatgttaaaaatatatgtttattttgtaggcgaatgatagatatatatattttttattttgttattaatatataattgatattgtatatatatatttgtagtagatatagattatataattatttgtttatgggttaaatttttacgttagataaagtataaatagatatgtatatagtaggttgttttttgttttgtaattttttttagttagatagtggagtagtcgggtattaaaggtatttagatattaggtttgattagtttttagggttttttgttttagttgagtttttttttttattttgtttttgtcggtttttggtaagttttagttttagttttgaggtgatgttttttgagaattttcgtggtttggttttttgttttgtagtttttcgtaggatgtttgtggggggcggggggtattttgagtagaagttatttgggtttaattatatataataggatattattttgaggtttttatcgtttgattattggagggttgaagtgagaggtttgtaggtttattttcgtggcgtaaaatcgtttttggtttattagtcggtttggatttgtcgttatattgttggttaggtttcgagatagacggggggggggtagtgagggttgggtgcggggtttagttttagttgagtagtagttcgtaagaatcggcggatttattttattagaagtcggaagttatttattttattagaagagtgaaagtcgattattttttaattcgtttgggagaattagattgtaattaggttaaacgtttgtgtgtttgcgcggaagtatggattttaattcgttatttggggattttagtaaaggaagagagagaaagaaaaaagattaaatttttgtagtcgcgaagtatgtttaatttttattgaaatttttaaattttttatttatattttaaggtaaatgaattttgattattaaaaataataaagtagttattttttatatttgtatagaggttagtagtttgtagcgtatttttataattagaattttatttattaatgtttggaataaatttttggttgttatagttgatttaaaatcgaaaagtttgagaataataataaaaatatagttagtttatatatttagtataattgtgtatgaggtagaatataaatttgaataggtataaaaataaattaagttttatttatagtcgcgttttgtgaacgaattacggtagaaaaagtttttttgttgacgttaaatagtcgtaacgggttagtgatgatatagaaaataaataattttaggaaaataaagtagtagcgatagttataaacgtttgttatttcggttgtttttaatttttgtttaatttattttgaaaaagataaaattttgttgaaaattttttttttttaattagttgttgaattaaggagcgatagaaataaagaagttcgtgttaaaagaaggaatataaaatttattcgggaatcgataaggtaaaaaataaaaataaaataaaaaaatataataaaagtgttttagttttttttagaaaatttggttttttaaataataagttatagtataattaggtttatggttttcgggtcgggtcggtttcgggttataagatcgtttaggtcggtcgttgtcgggttttatattttttttttttaaggtgggagaagtaggaggtttgaaaaataaaaagtagggaggacgagtcgttttagtagcgtgggttaggtaggtagtgatttttttgtttttaggatttgtatcgaaagattcggggatatttgtttttgatttttttttttagatagggagagggtgaaatttttttaattggtagacgaaattattttttattggatatatttttttaattttgaatatagttttttgaaggtttaataaaaattttaacgtaaattttttagaagagaagatgaggaatattaaagtttttgatttttatatttggatttagtaaattttaaggttataatattttttcggttgttcggtgaatttttttttttttttttttttttaaatatttttttaaaaagttttatcgattttttaaataaaatattagttagtcgtcggggttcggaggtgttcgaagcgacgggattgatagcggaggaaacgtagttttttttcgcgttcgttcgcggtgtaaatcgagtataggtcgtggagttaggttgtttcggttttcgttgggttttaattttcgtttcgtttagtgggtttcgcggtaagcggtttttgaatagttttaagagggttcgcggagtaaatatacgtattggttcgtttttttttcgggtagcgcggtttcgttattagttttgttcggcgcgtttagttatggattgtacggtagtcgggcggggaacgcggagagcgagcgtatcgatttgtgagagaaggttaagaggtttgcgttgtcgacgttcggtcgtattttcgtttcgggtttttttcgcggtgaatttgggtaggagacgttggggtttcggaaagagacgagtttagtagaaagcgcgtagagaggtagttttaggttaggggagtgtaaggttatagaggttagggaggtgagtataggaggatataaattgaggggataaagaggagcgataggagtttaggaaagcgaaaaagtatagagggattttgggcgttggttttagaggcgggtttagagggtgtgaggttaggttggcggcggcgtcgtcggttgcgatcggggtcggcgtcgcgcgtttttgtattttcgtattcgtttgtatcggtatgcggtgggtttttagagatcgaggcgcgaatgtagcgcgtcggttttgttgtcgtggttttagtaagagtaatgtattatggcgagttcgggttgtcgggtataagcgaattgtaggttcggcgtattggtgggcgcgggcgtcgggggcgcggcggtggttgggttggtagggttgagttggttcggcggcggcgcggcggtttcgtggtgcggtggggtaggcggcggtgcggcggtcgcgtgtagatggtgtgcgtgcggatgcgggtgggggtgcggcggaggcgggggtgcggtcggcgggttttttaggttattgtacgagtttattacgtcggggggtagcgttatgttttgtacgcgtgtgtacggttcgtacgaggcggtcgggttcgttagttttttgattatagcggtcgcgttagggttatcggggttcgcggttgtagtcgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcgttcgtcgtcgttttcgcgcggtattttgatgaagtattcgttgaggttgaggttgtggcggatgttattttgttagttttttttatttttttcgtagaacgggaatttcgcgatgatgtattggtagatgtcggatagcgtgagtttttttttcgcgttttcgcggatcgttatggcgatgagcgttacgtacgagtacgggggtttttgcgtcgggttcggttttttcggggttgtttcgtcgttatttttatcgtttttgtttgggttcggcggcggtttttttggttttttgattgtgcgatcggtttttggggttagtagggttttcgtcgcgttttcgggttcggggtagttggttattatgataaagtcggcgcgtcgcggtcgggtcgtttttgtttttcgttttaggcgttggcgcggtaaagagttggggcgtacgagttcgtttacggttaagttttaaatttttggagattgcggatgtcgttcgcgtttgtttgttggaggtttgtcgttgttttttttttttttttttttttttttagggagcggtcggcgggagtggagtttagtttttggttatggggagttcgtttaatagagaggggtttcggtttcgtcgttttttttcgtttaggttagttttcgttttggtgggtttttttttttgcgtttttttttttttttcgtttttcggtttttcgaagtacgattcgcgtttttggcggagttgttttttggagtttttagtgcgttaggagtttcgttttgttttgattcgtatgggttttatcgagtttcgtttgcgttaggcgttttcgtttttatagcggggcggttagtcgcgtacgggcgagtttatttttaagttattttttgtaaacgtttcgtatagtttggatcggtttgttttcgtttagcgagttttaggggtttagtcgatagttaggtttacgcgtttttgaaatttgtcggtattcgttttgcgggttgggttgggagatgacgaggatttcggtggggtttgttcgtattcggttaaagtttaggaagttcgggttttagcgaggaaaggcgttttaagttttttcgcggtttttaggtgaaagaaaacgatttttttgttttgtcgtttgttgtcgttttgaggttgaatttttagttcggggttggggaggggcgagacggcgagggggttggacggggtagggtggggagagttgttttgaggttttgggaaagttagtttagaaacgggtgtgattgtacgaagaagtttcggtttggtttgtttttcgcgtttttagagtgattgggttggaatggggtaggggagaggatttttggaaatagtcgttaggggcgtcgtttgaattatttttgtttttttttgcgttattagtggatttaggaattaggaattcgtgtattaattttacggggttggagtgaaggttggatgtgtgttttaatagtattaagtagatgttttttagttattgtattaatataggcggggttgttgttcgggattttgcgggattgtgtatgtgtgtgtataggggttatatatggaagttatggagaggagttgtttttgagatgggtgagatattaggtgtatgtgtgttgtttagaaatataggtatgtatatgtataaggtgtgagatttgtatttacgaggtaaaatatatttatattgatagttatgtaatatgtttattaagtattagagtaaatgtagttggtggatatagtattttttttttttttttttttttatttttttttttttttttttttttttttttttttataatttttcgatgttttttttttttttagtgtatgtattttgttatagattgggaagataaatattaggttgagggagggatttgtttaaattttttttttgatgagatatttgttttgatttttttttaaagaattaggagttagttgttatttattttaagtagaattttgatgggaatttaattattttagtatgtatagagattgttttagggaaaattaggtgtgttttttaatagtgtgttttttaatagtgttttttaatttggtttaaataaaaagtttgtagttataaagtatgagagagatggttagtgttttgaatttttaagttttaaattttttggtgttgaggaggggggtaaggttattttatggaggaaggtggattgaatggatgttatatagttgtgtattagtgattggtatgtttggagtggttgatttaatgtttgttattgttttttttttttaggttgtttagattttgagggtttttttgaagtttaaggagtttttagcggtttgtggttttagtatttataggttatttataagtgttgtttgttgtttatttaggtttttgatttgtattttgagatgaaagggagggaggataagggtggtagggttttttggaatttagtattttgaagatgatattagagaggttagtagggtagtttttgtttggttataaggatgagagggagtaaggttatttttaaagtagtttggttttttttatgggcggttttttattgtatttaatagatatgggggaagtagtattttcgtagaatttttgttgttgttttttgagtaggagtgtagatgtttttttttttttttatttttatttttgtttaagttttgggtgggagtggtgagttcggtttggggttgttgtagattggttttagtgtttatttttttttagttagggtttgggtagggggaaaaatagttgggtttggttttattttggtgggggtttttttttttttttttttttttttttttttttttgattatttaggttggttttttgcgtttttttgttttttttttttttttttataggtattttcgttgtttagttttgtagtagttaggtgtaatagtattgttgtgtgtgttattatttttttgaattttatattcggttttttttttagtttttaaagagtttgtgtgtgtatgtatgtgcgtgtgtgtgtgtgtgtgtgtgtgtgtaggggttgggggtaaatgaaggagtttttttgaaggatttttagaatagaaaggagttttgttttgaaaatattgatttttgattgtttcgtagaggaatagaatttttagttttggtgaagaagaggatgtttgatgcgtgtattttgggaagggttggaatcggtttttttaagatgtgtttttatatggttgttcggtattcgaaggtttagaaaataggtaagaaaatgcgggcgggaaagttggtagaatgattatttttaggttttttttaggtttttgcggaaaagttaggggtttcgggttggagatagaggaatttagggagagaatagaattttttttttgtcggtttagttagaggtgggtgaatcgggcgttttaggaaacggtgcggggcgttttgatttattttttaattttcggaggtaggttggttgttggcgaggtcgggattttttttgaatagggtatattgtgtttaggttttgtggacgttagggtcggtttttttttttttcgcggtattggggcgacgtagggttttcggtttagtgattttggggcggcgtttatttttaaaggttagggtggtgggttgggtagaatttattgtttttttgttttagttttttagggtttcgtagttgtaatttagtagttatcggcgttttttgatcgtggttttatcgtagcgtcgtttgcggatacggttttagtgaatcgtcgattgagcgtagttttagttttcgcgttttttcgtagtttggtttcgcgtttcggaggtttcgatagtcggcgcgagtaatttatacggttttgatatagacgtttttttttttagggtcgggaattttgtaatagcggtagaagtcgttcgcgtttcgggttttcggcggtttagttttattagggaagcgtcgcggttgttttgaggtaggtagcgtttcgttagaattatttagttcgtttcgcgtcgtcgtcggttgtttgaattaggtttcgttgtttttttttttagcgggatttcgaaatattcggcggtttttcgtttttgagcgggagagaatagagtttgttgtaattttttgtttggagggatggtttttgcggtgtttggttagtaaagggaagttttattgtgtttattagtatatttttatatattttacgttttaataattgttagtatttattttttttcggttttttatagggttttttgtatttatattttagggattcggtgtttttttatttaggttacgttattttatttatttttttttttttttttttttgttaattttaaattttttttagttttttttttttttttattttttttatatttattagttatacgtattaatttagattttgtatatgttggtggaaaatatgttaagttaatgtgtagattttaaggttttttatacgttgtttattttcgtattttacggtgtagaaggattaatgggttttaggtttataagtttgatttcgagaagtttgttgattttttgatgtttttggtttgtgattcgggtgattgggttgttatttgggtgtttttatgatgggattgtcgtatagattatagagaagtttaggtattgagtacgttttagatatattttaatatgtataggttatttatataggttttatttttgtttcgaaattttgttgagtttgttgtttagattaataaggtgtagtagtagatatttatatagtattaggtttgaagttagtgggtattagtttgtttggttgggattagtaaagttagttatttatatatgtgtttgggagagaataggggagtggagagagagagagagatattgaggaagaggaaagagaagcgattttttattttgggaagaatttatatatgagagttgttttttgttgttaagtgttttattgagttttttttttttttttttaggaagggtttgagaggtagtagattagagttttgggtttttttttattttgttgatgttggggtatgagttttttaatattattttgttttaaggagtatgtgttttatcgttaattaggtagaatgtagggtagttgtcggttttttttatggtggaggttaattgggaaaaaggtagaagggtttgggttttgggttaagtgaggtttttttttttttaaagattcgtgggatgtttttagaggcggattttagggtggtgggagttgttgataagttttttttgatattttttatgatatttatggtttaaagttattttgtttagttttgaatagtgagtgttttgttagtaggttttaggtttgttggggaatatgatgtgtttttaaaagttgttttgttgtttttttttatatttagattgtaagcgttgatgggtagagattttgttttttattttttatttagtgttttttattaggatgggtttaatgttttttaatagaattagaaaatggttttgttggatagaattgggaaatgttattttttttataatgaagttataatgaagttagaatttttaagaaagggattgtagttgaggaaaagcggtttgattattgatagttagtttaggatttgagagttttttgttatttggggttattatagttgtatggttatggtgttgaattttaggtaagggtaaggatatttttttagtttttagttatggtgaggatttgtttgaaatatt

SEQ ID NO: 3 - DNA, 12917 bp, Artificial Sequence
  bisulfite converted genomic DNA
aatatttcaaacaaatcctcaccataactaaaaactaaaaaaatatccttacccttacctaaaattcaacaccataaccatacaactataataaccccaaataacaaaaaactctcaaatcctaaactaactatcaataatcaaaccgcttttcctcaactacaatccctttcttaaaaattctaacttcattataacttcattataaaaaaaataacatttcccaattctatccaacaaaaccattttctaattctattaaaaaacattaaacccatcctaataaaaaacactaaataaaaaataaaaaacaaaatctctacccatcaacgcttacaatctaaatataaaaaaaaacaacaaaacaacttttaaaaacacatcatattccccaacaaacctaaaacctactaacaaaacactcactattcaaaactaaacaaaataactttaaaccataaatatcataaaaaatatcaaaaaaaacttatcaacaactcccaccaccctaaaatccgcctctaaaaacatcccacgaatctttaaaaaaaaaaaaacctcacttaacccaaaacccaaacccttctacctttttcccaattaacctccaccataaaaaaaaccgacaactaccctacattctacctaattaacgataaaacacatactccttaaaacaaaataatattaaaaaactcataccccaacatcaacaaaataaaaaaaaacccaaaactctaatctactacctctcaaacccttcctaaaaaaaaaaaaaaaaaactcaataaaacacttaacaacaaaaaacaactctcatatataaattcttcccaaaataaaaaatcgcttctctttcctcttcctcaatatctctctctctctctccactcccctattctctcccaaacacatatataaataactaactttactaatcccaaccaaacaaactaatacccactaacttcaaacctaatactatataaatatctactactacaccttattaatctaaacaacaaactcaacaaaatttcgaaacaaaaataaaacctatataaataacctatacatattaaaatatatctaaaacgtactcaatacctaaacttctctataatctatacgacaatcccatcataaaaacacccaaataacaacccaatcacccgaatcacaaaccaaaaacatcaaaaaatcaacaaacttctcgaaatcaaacttataaacctaaaacccattaatccttctacaccgtaaaatacgaaaataaacaacgtataaaaaaccttaaaatctacacattaacttaacatattttccaccaacatatacaaaatctaaattaatacgtataactaataaatataaaaaaaataaaaaaaaaaaaaaaactaaaaaaaatttaaaattaacaaaaaaaaaaaaaaaaaaaaataaataaaataacgtaacctaaataaaaaaacaccgaatccctaaaatataaatacaaaaaaccctataaaaaaccgaaaaaaaataaatactaacaattattaaaacgtaaaatatataaaaatatactaataaacacaataaaacttccctttactaaccaaacaccgcaaaaaccatccctccaaacaaaaaattacaacaaactctattctctcccgctcaaaaacgaaaaaccgccgaatatttcgaaatcccgctaaaaaaaaaaacaacgaaacctaattcaaacaaccgacgacgacgcgaaacgaactaaataattctaacgaaacgctacctacctcaaaacaaccgcgacgcttccctaataaaactaaaccgccgaaaacccgaaacgcgaacgacttctaccgctattacaaaattcccgaccctaaaaaaaaaaacgtctatatcaaaaccgtataaattactcgcgccgactatcgaaacctccgaaacgcgaaaccaaactacgaaaaaacgcgaaaactaaaactacgctcaatcgacgattcactaaaaccgtatccgcaaacgacgctacgataaaaccacgatcaaaaaacgccgataactactaaattacaactacgaaaccctaaaaaactaaaacaaaaaaacaataaattctacccaacccaccaccctaacctttaaaaataaacgccgccccaaaatcactaaaccgaaaaccctacgtcgccccaataccgcgaaaaaaaaaaaaaccgaccctaacgtccacaaaacctaaacacaatataccctattcaaaaaaaatcccgacctcgccaacaaccaacctacctccgaaaattaaaaaataaatcaaaacgccccgcaccgtttcctaaaacgcccgattcacccacctctaactaaaccgacaaaaaaaaaattctattctctccctaaattcctctatctccaacccgaaacccctaacttttccgcaaaaacctaaaaaaaacctaaaaataatcattctaccaactttcccgcccgcattttcttacctattttctaaaccttcgaataccgaacaaccatataaaaacacatcttaaaaaaaccgattccaacccttcccaaaatacacgcatcaaacatcctcttcttcaccaaaactaaaaattctattcctctacgaaacaatcaaaaatcaatattttcaaaacaaaactcctttctattctaaaaatccttcaaaaaaactccttcatttacccccaacccctacacacacacacacacacacacacacgcacatacatacacacacaaactctttaaaaactaaaaaaaaaaccgaatataaaattcaaaaaaataataacacacacaacaatactattacacctaactactacaaaactaaacaacgaaaatacctataaaaaaaaaaaaaaaaaacaaaaaaacgcaaaaaaccaacctaaataatcaaaaaaaaaaaaaaaaaaaaaaaaaaaaaaaaaaacccccaccaaaataaaaccaaacccaactatttttccccctacccaaaccctaactaaaaaaaaataaacactaaaaccaatctacaacaaccccaaaccgaactcaccactcccacccaaaacttaaacaaaaataaaaataaaaaaaaaaaaaaacatctacactcctactcaaaaaacaacaacaaaaattctacgaaaatactacttcccccatatctattaaatacaataaaaaaccgcccataaaaaaaaccaaactactttaaaaataaccttactccctctcatccttataaccaaacaaaaactaccctactaacctctctaatatcatcttcaaaatactaaattccaaaaaaccctaccacccttatcctccctccctttcatctcaaaatacaaatcaaaaacctaaataaacaacaaacaacacttataaataacctataaatactaaaaccacaaaccgctaaaaactccttaaacttcaaaaaaaccctcaaaatctaaacaacctaaaaaaaaaaaacaataacaaacattaaatcaaccactccaaacataccaatcactaatacacaactatataacatccattcaatccaccttcctccataaaataaccttacccccctcctcaacaccaaaaaatttaaaacttaaaaattcaaaacactaaccatctctctcatactttataactacaaactttttatttaaaccaaattaaaaaacactattaaaaaacacactattaaaaaacacacctaattttccctaaaacaatctctatacatactaaaataattaaattcccatcaaaattctacttaaaataaataacaactaactcctaattctttaaaaaaaaatcaaaacaaatatctcatcaaaaaaaaaatttaaacaaatccctccctcaacctaatatttatcttcccaatctataacaaaatacatacactaaaaaaaaaaaaaacatcgaaaaattataaaaaaaaaaaaaaaaaaaaaaaaaaaaaaaaataaaaaaaaaaaaaaaaaaaaaatactatatccaccaactacatttactctaatacttaataaacatattacataactatcaatataaatatattttacctcgtaaatacaaatctcacaccttatacatatacatacctatatttctaaacaacacacatacacctaatatctcacccatctcaaaaacaactcctctccataacttccatatataacccctatacacacacatacacaatcccgcaaaatcccgaacaacaaccccgcctatattaatacaataactaaaaaacatctacttaatactattaaaacacacatccaaccttcactccaaccccgtaaaattaatacacgaattcctaattcctaaatccactaataacgcaaaaaaaaacaaaaataattcaaacgacgcccctaacgactatttccaaaaatcctctcccctaccccattccaacccaatcactctaaaaacgcgaaaaacaaaccaaaccgaaacttcttcgtacaatcacacccgtttctaaactaactttcccaaaacctcaaaacaactctccccaccctaccccgtccaaccccctcgccgtctcgcccctccccaaccccgaactaaaaattcaacctcaaaacgacaacaaacgacaaaacaaaaaaatcgttttctttcacctaaaaaccgcgaaaaaacttaaaacgcctttcctcgctaaaacccgaacttcctaaactttaaccgaatacgaacaaaccccaccgaaatcctcgtcatctcccaacccaacccgcaaaacgaataccgacaaatttcaaaaacgcgtaaacctaactatcgactaaacccctaaaactcgctaaacgaaaacaaaccgatccaaactatacgaaacgtttacaaaaaataacttaaaaataaactcgcccgtacgcgactaaccgccccgctataaaaacgaaaacgcctaacgcaaacgaaactcgataaaacccatacgaatcaaaacaaaacgaaactcctaacgcactaaaaactccaaaaaacaactccgccaaaaacgcgaatcgtacttcgaaaaaccgaaaaacgaaaaaaaaaaaaaaacgcaaaaaaaaaaacccaccaaaacgaaaactaacctaaacgaaaaaaaacgacgaaaccgaaacccctctctattaaacgaactccccataaccaaaaactaaactccactcccgccgaccgctccctaaaaaaaaaaaaaaaaaaaaaaaaaacaacgacaaacctccaacaaacaaacgcgaacgacatccgcaatctccaaaaatttaaaacttaaccgtaaacgaactcgtacgccccaactctttaccgcgccaacgcctaaaacgaaaaacaaaaacgacccgaccgcgacgcgccgactttatcataataaccaactaccccgaacccgaaaacgcgacgaaaaccctactaaccccaaaaaccgatcgcacaatcaaaaaaccaaaaaaaccgccgccgaacccaaacaaaaacgataaaaataacgacgaaacaaccccgaaaaaaccgaacccgacgcaaaaacccccgtactcgtacgtaacgctcatcgccataacgatccgcgaaaacgcgaaaaaaaaactcacgctatccgacatctaccaatacatcatcgcgaaattcccgttctacgaaaaaaataaaaaaaactaacaaaataacatccgccacaacctcaacctcaacgaatacttcatcaaaataccgcgcgaaaacgacgacgaacgcaaaaacaactactaaacgctaaacccgacctacgaaaacatattcgaaaaaaacaactaccgacgccgccgccgcataaaaaaacccttccgaccgccgcccgcgcacttccaacccgacaaaaaactcttcgaaaccgaaaacgccgcaaacgaatacgacgtaacgaacgccgaaaccgacgactacgactacctaacgccccccaaatacctacaatctaacttcctcaacaactcgtaaccgctaccgcaacctccctcacccataccctatacctcctaccaaataacgacaaccgcaacgactacaacaactacgactacaaccgcgaaccccgataaccctaacgcgaccgctataatcaaaaaactaacgaacccgaccgcctcgtacgaaccgtacacacgcgtacaaaacataacgctaccccccgacgtaataaactcgtacaataacctaaaaaacccgccgaccgcacccccgcctccgccgcacccccacccgcatccgcacgcacaccatctacacgcgaccgccgcaccgccgcctaccccaccgcaccacgaaaccgccgcgccgccgccgaaccaactcaaccctaccaacccaaccaccgccgcgcccccgacgcccgcgcccaccaatacgccgaacctacaattcgcttatacccgacaacccgaactcgccataatacattactcttactaaaaccacgacaacaaaaccgacgcgctacattcgcgcctcgatctctaaaaacccaccgcataccgatacaaacgaatacgaaaatacaaaaacgcgcgacgccgaccccgatcgcaaccgacgacgccgccgccaacctaacctcacaccctctaaacccgcctctaaaaccaacgcccaaaatccctctatactttttcgctttcctaaactcctatcgctcctctttatcccctcaatttatatcctcctatactcacctccctaacctctataaccttacactcccctaacctaaaactacctctctacgcgctttctactaaactcgtctctttccgaaaccccaacgtctcctacccaaattcaccgcgaaaaaaacccgaaacgaaaatacgaccgaacgtcgacaacgcaaacctcttaaccttctctcacaaatcgatacgctcgctctccgcgttccccgcccgactaccgtacaatccataactaaacgcgccgaacaaaactaataacgaaaccgcgctacccgaaaaaaaaacgaaccaatacgtatatttactccgcgaaccctcttaaaactattcaaaaaccgcttaccgcgaaacccactaaacgaaacgaaaattaaaacccaacgaaaaccgaaacaacctaactccacgacctatactcgatttacaccgcgaacgaacgcgaaaaaaaactacgtttcctccgctatcaatcccgtcgcttcgaacacctccgaaccccgacgactaactaatattttatttaaaaaatcgataaaactttttaaaaaaatatttaaaaaaaaaaaaaaaaaaaaaaattcaccgaacaaccgaaaaaatattataaccttaaaatttactaaatccaaatataaaaatcaaaaactttaatattcctcatcttctcttctaaaaaatttacgttaaaatttttattaaaccttcaaaaaactatattcaaaattaaaaaaatatatccaataaaaaataatttcgtctaccaattaaaaaaatttcaccctctccctatctaaaaaaaaaaatcaaaaacaaatatccccgaatctttcgatacaaatcctaaaaacaaaaaaatcactacctacctaacccacgctactaaaacgactcgtcctccctactttttatttttcaaacctcctacttctcccaccttaaaaaaaaaaaatataaaacccgacaacgaccgacctaaacgatcttataacccgaaaccgacccgacccgaaaaccataaacctaattatactataacttattatttaaaaaaccaaattttctaaaaaaaactaaaacacttttattatatttttttattttatttttattttttaccttatcgattcccgaataaattttatattccttcttttaacacgaacttctttatttctatcgctccttaattcaacaactaattaaaaaaaaaaaattttcaacaaaattttatctttttcaaaataaattaaacaaaaattaaaaacaaccgaaataacaaacgtttataactatcgctactactttattttcctaaaattatttattttctatatcatcactaacccgttacgactatttaacgtcaacaaaaaaactttttctaccgtaattcgttcacaaaacgcgactataaataaaacttaatttatttttatacctattcaaatttatattctacctcatacacaattatactaaatatataaactaactatatttttattattattctcaaacttttcgattttaaatcaactataacaaccaaaaatttattccaaacattaataaataaaattctaattataaaaatacgctacaaactactaacctctatacaaatataaaaaataactactttattatttttaataatcaaaattcatttaccttaaaatataaataaaaaatttaaaaatttcaataaaaattaaacatacttcgcgactacaaaaatttaatcttttttctttctctctcttcctttactaaaatccccaaataacgaattaaaatccatacttccgcgcaaacacacaaacgtttaacctaattacaatctaattctcccaaacgaattaaaaaataatcgactttcactcttctaataaaataaataacttccgacttctaataaaataaatccgccgattcttacgaactactactcaactaaaactaaaccccgcacccaaccctcactaccccccccccgtctatctcgaaacctaaccaacaatataacgacaaatccaaaccgactaataaaccaaaaacgattttacgccacgaaaataaacctacaaacctctcacttcaaccctccaataatcaaacgataaaaacctcaaaataatatcctattatatataattaaacccaaataacttctactcaaaataccccccgccccccacaaacatcctacgaaaaactacaaaacaaaaaaccaaaccacgaaaattctcaaaaaacatcacctcaaaactaaaactaaaacttaccaaaaaccgacaaaaacaaaataaaaaaaaaaactcaactaaaacaaaaaaccctaaaaactaatcaaacctaatatctaaatacctttaatacccgactactccactatctaactaaaaaaaattacaaaacaaaaaacaacctactatatacatatctatttatactttatctaacgtaaaaatttaacccataaacaaataattatataatctatatctactacaaatatatatatacaatatcaattatatattaataacaaaataaaaaatatatatatctatcattcgcctacaaaataaacatatatttttaacattataataatcatataactaacacttaaaaaatacttactaaaaccacaatatatataacattcatacctcattaataatatatacatttataaatatatattcctaacttactaaaaaataaaataatataaacaaaacctttacttcatcaaacaaaaactccctattctaaaactaactatcaacactcccccaactaccgtctcaaacaaaaaaaacaaaaaaaaaaaacttccaaaaccaaaccctaataaacaaataacaacccacctccaataaaacgaaaaaattaaccgaaaccaacaataaaaaaccaacctatctcctccccgaaaactaaaaaacaaaaaacacccaaaactaaaaaaaaaacaacaacctcaccaaataaaaaaaacaaaataaaacaatcaataaaaatttcctaaatctacacaaaaattaaaaaaaataaaaaaaaaaaaccaaatcataccccacttccccataaatacccacaaaaaaaatctatctaactccaaccctcgaaatttctccaaaactcttaaatttaatcattttccccaaaaccgaaaatttaattcaataacaaactttcttcatctctcatttcctttctcttctctccctcttcgcacttttaaatttctattataaaaactaatttaaacaattcctaaaaacaaaaatatttaaattatataacaattataccttaacatatacaatctaacctaaataactaaaccatataaatatatatatatatattaaccaatatataaatacaatataaataaaatttaatacaaatacccaaccaatttctaaatatcctaaataataaatcgttcttacataaaaattatatatataataaatataaacatctcacacactactaacaatataaaccctctcctcacatttacacaaaaattcttaaaatcacctccacctcactaaaattacccaatcaaaataaataaattaatttaaaaaaaacaaaaaaaaatatcctattctcaaaaaaaacctaaaaaaatcttcgccattaaaatacatacaccaaaaaactataaaaaaaaaacctacgaaattctaaaaataatcctataccctactccaaaaaatattaacgtcctatttccaacttacatcaataaataattcactactccaaatctaaaacttaaataaacaaaaaaccctaaacctttcatccgaaattaaatacatccaacctttaccaaaatttcctaaaaaccaaaactaaaaataaaactacaaaaaaccccctaacgacgaataaaaattaaaaccaaacccaaacttcatacaaccaaacaaacaaaatataaaccaaaaatctaaatctaacccaaaataatttactctcaactaaactcttccctttataaaaatctaaaccaaacttcataaacaaaatcaccgaaccaaactcctaacttctaaataaaaatctaaaaccaaaaaacatcttaatcaaactcaacatccctacaatatccccattctacaaatctaacctaataataaccctaaaaccctacccgtcaaacctaccaccactatataacaacccctacttcttaaaataaactataaaacccataaaaaaaataaaaaaaaaataaaactaaaaaccccataccttcgaaacaaccaaaaattaaaaattcttaaaaccgaacaatcttaacaactttccactttctaaaaaaaaaactcccaactatcataaaaaaaatatcttaaatctaaaaacccaaaattacattacatttaaaaaatctcaaatcctaaaaaaaaaaaaaaccaaccaaaaatcttccaaatatctataaaacaaataacctccgaaatttttaaaaaaaacttaacaacaactaaacctaactaccactaatactcaaaaaaactacgtaataaaaaaaaacctcccaaaaataataaaaaaaaacctcccaaaaaaaaaaaaaaacacaatctaaactataccttttaccttttttatttatttctataccacaaaaactactactacacaaactatttaccgcacaaacttaatactaaactataaaaaacatattctaaaatcttatcacttcgcgaaaataacctatacaacataaaacaaaaacctaacctatttaatcaaaaaaaactaaattaaaacctaatatcctctttaacaactatataaccttaaacaaaatacccattcaaatttcaatattctcctctataaaacaaaaatacgtacgtatatcaaaattattaaaataattaaattttctaatttttaaatacccaatttataataaatattcaataatattttttcccttcccctattaaaaaaaaaaaaaaaaaaaaaaaaacaaaaaaaaaaaaaaaaaaaaaaaaaaaaaaaaaaacctttaataataactttctaaaatttaacttcctaacccaactaaccacaaacaccccctacgaacaccttccgaaaccaaacgcacgcgattacatccaccctaccctaaccccttaaccgtaaaaataaaactcacgcgattaccgttacaacgaacacccaaaccctaaaaacacaactaataaacgctaaaaccccgcccgaaactcctccaacctccctctcgcttcccccaaaacgatcttcacacgtttaaaaaattttctctaaaaaaaaccgtactaacccgcgaaacgacaccgacccaaaaacctactcataaactatccgactaacgcctccaatcctcacgcgcctccctcgactaattaattttttctttttttttttttttttccttttctttttcaaaaaaacaaaaaataaccaccgaaccaaaaattacaaaatcaacctataaacgaaactcccctaaacctttataaaaaaacgaaaaacctaaaaaacaaacgcaaaaaacgaattaaatcaattacgaacgaccgaaacgccgccaacgaataaaaaacgaaaaaaaccaacaaccgaaaaaaccccgacctaaaacgcctcgtatccccgaacctattaacgacgctacaaacccaaatcttaaaacgcgaactaaatcccccttaccaactctaaacaaaattcgaaaaaaaataaatcgaccaatctaaacacaaaatactctcgactaccgaacgacgaacgaaaacgcaaaaaccctaatcgcccccaaaaatactaaacgcacaaaacaataactacaaaaccccgacgcgaaaccaactcgaatcatccacgttaaaacctcaacctacccgattatccttaataataataataatataaaaccgaattttaaaaaacctttccccgcattttcctctatatacaaaaaaaaacaaatatttctaaacaatcaaaaaaaaaaaaaaaacaaaatcccaaaaaactttaatctctataaacgaaaaataaaaaaaaattcgccttttaccttttttatttatttatttctaaaaaaaaaaaaaaaaaaattcgacacatattttt

SEQ ID NO: 4 - DNA, 12917 bp, Artificial Sequence
  bisulfite converted genomic DNA
aaaaatatatatcgaatttcctttttttctcttctaaaaacaaacaaacaaaaaaaacaaaaaacgaattccccttcactcctcgtccataaaaattaaaatttcctaaaatcctaccctttttttttctttaactacctaaaaatacttattctcccttatacataaaaaaaaatacgaaaaaaaattttttaaaactcgatttcatactattattattactaaaaacaaccgaacaaactaaaatcccaacgtaaataatccgaattaacctcgcgccgaaactctacaaccactaccctatacgctcaacacctctaaaaacgatcaaaacccctacgcttccgcccgccgcccgacaatcgaaaacaccctatacccaaactaaccgactcattctcccccgaattttatttaaaactaacaaaaaaaacttaactcgcgccccaaaacctaaacttacaacgccgccaacaaacccgaaaacacgaaacgctccaaaccgaaatcttcccgactactaacccctctcgctccccacccgctaacgacgcctcgatcgcccgcaattaacccaacccgcttcctacgtttacccctcaaatttcccgtttctccacaaaaacctaaaaaaacctcgcccacaaactaaccctacaacctctaacccgataactaccttctacttttctaaaaaaaaaaaaaaaaaaaaaaaaaaaaaaaaaaaaatcaaccaatcgaaaaaaacgcgtaaaaactaaaaacgccaaccgaacaacctataaataaatccctaaatcgataccgcttcgcgaatcaacacgacctttctcaaaaaaaacctcctaaacgtataaaaaccgctttaaaaaaaacgaaaaaaaaattaaaaaaaccccgaacgaaatctcaacgcccaccaactataccttcaaaacttaaatattcgctacaacgacaaccgcgtaaacctcactcccacgaccaaaaaactaaaacaaaataaatacaatcgcgtacgcctaaccccgaaaaatactcgcaaaaaatacctataaccaactaaattaaaaaatcaaatcctaaaaaattattactaaaaattttttttcccccttcctttcttctttccttttttacttccttccttccttttttttttttaataaaaaaaaaaaaaaaacattattaaacatctactataaactaaacacttaaaaattaaaaaatttaattattttaataattctaatacacgcacgtatttctattttataaaaaaaaacactaaaatttaaataaatattttacccaaaattacataactattaaaaaaaacaccaaactccaacccaattcttcctaactaaacaaaccaaatctttacctcatactacacaaaccacctccgcgaaataacaaaatcccaaaacatacttttcacaactcaacaccaaacctatacgacaaacaacctatacaacaacaatttctataatacaaaaacaaacaaaaaaaacaaaaaacacaactcaaactatacttccttcttctcctaaaaaactctcccttactactcctaaaaaactctcccttactacgcaactcccttaaacatcaataacaactaaactcaactactatcaaatctcctttaaaaatttcgaaaaccatttacctcacaaatacctaaaaaacctctaattaatctcttctcttcttaaaacctaaaattcctcaaatataatataattttaaattcctaaacccaaaacactctttttataacaactaaaaatcctctctccaaaaaataaaaaattactaaaactactcgattttaaaaatccttaattcctaattatcccgaaaacataaaactcttaatcccatcctttccccatcttttctataaatcccacaatctactccaaaaaataaaaactaccacacaataataataaacctaacgaacaaaaccccaaaatcaccaccaaattaaatctacaaaataaaaacactacaaaaatactaaacctaatcaaaatatttcctaaccttaaacccccacccaaaaaccaaaaatctaatccgataatcctatccataaaacctaacccaaaccttcataaaaaaaaaaactcaattaaaaacaaactatcttaaaccaaactcaaattcctaacccatattctacttatctaactacataaaacctaaatctaaccccaatttccacccgccgccaaaaaactccttacaaccccatctccaaccttaacttccaaaaaaccctaacaaaaactaaatacacctaacctcgaataaaaaatccaaaacctcttactcatctaaacctcaaatctaaaacaataaactatttactaatacaaactaaaaacaaaacgtcaataccctctaaaataaaatacaaaaccatctccaaaactccgtaaatccctttcccacaatcccttaatacatatacttcaataacgaaaatttctccaaatccctcttaaaaacaaaacacctccccctactttctccaaaccaacccacttactctaactaaacaattttaataaaataaaaataactctaaaaatttctatataaatataaaaaaaaaactcatactatcaacaatatataaaatatttacacccaccacacacataatcttcatacaaaaacgactcattacccaaaacattcaaaaattaactaaatatttatattaaactctatttacattatatttacacactaaccaatatatatacacacactcacataacccaaccatctaaaccaaactatatatactaaaacataattactatataactcaaatacttttaccctcaaaaattacttaaatcaacttctataataaaaactcaaaaatacgaaaaaaaaaaaaaaaaaaaaaaaataaaaaataaaaaaaacctaccattaaactaaactttcgaccctaaaaaaaataaccaaacttaaaaactttaaaaaaatcccgaaaactaaaattaaacaaatttttcctataaacatccataaaaaaataaaatataatttaactcccttctctcacctccttcaatccctatataaacccaaaaaaccctcactaattacttcattttatcttccttacttaataaaactactactctcttcccaaccttaaataccttttacctttcaattctcgaaaaaaaaacaaactaatccttcattactaaccccgaccaacttctccgtctcactaaaaataaactactacctacccaccaaaacttaatcctaaaaacttccctcccttactttctctacttaaaacgacaattaaaaaaatactaacaaccaacttcaaaacaaaaaacctctacctaataaaacaaaaactctatccatattactttatttttcaacaaaccaaaaatacacacccacaaatacacacatcaccaataaaatataaataccacacacactataatcccaataaacacttcctaaatattaaccatataattattacaataccaaaaatatatacccactctacaaacgaataacaaacacacacacctcccaccctatcaccaatacacaactaacactatacacacacatttacaacaaatacaaactacacaattacttacccataaactaaattttcacgctaaacaaaacacaaacaaacatacacacaacaaactactttctattctacaactccccttaaccaaataataaaacaaccgaacaccaaaaacacccaaacaccaaacctaaccaacctctaaaacttcctactccaactaaacctccctctccatcctactcctaccgattcctaataaactccaatcccaatcttaaaataataccccctaaaaatccccgtaacttaatctcctaccttataacctctcgcaaaatacctataaaaaacgaaaaacattctaaacaaaaaccacttaaacccaactatacataacaaaataccaccctaaaattcctaccgcctaaccactaaaaaactaaaataaaaaacctacaaactcattcccgtaacgcaaaaccgctcctaacccaccaaccgacctaaacctaccgccacattactaaccaaaccccgaaataaacgaaaaaaaaacaataaaaactaaatacgaaatctaatctcaactaaacaacaacccgcaaaaaccgacgaatctatcctatcaaaaatcgaaaatcatctatcccatcaaaaaaataaaaaccgaccaccccctaatccgcctaaaaaaaccaaactacaaccaaatcaaacgcctatatacctacgcgaaaacataaatcttaattcgttatttaaaaatctcaataaaaaaaaaaaaaaaaaaaaaaaaaactaaatttctacaaccgcgaaatatattcaatccttactaaaacctccaaatctcctacccatatctcaaaataaataaattctaactattaaaaataataaaacaatcacttctcacatttatacaaaaattaacaatttacaacgcatttccacaaccaaaattttatctattaatatttaaaacaaactcttaactattataattaactcaaaatcgaaaaatttaaaaacaataataaaaacacaaccaacccatacacctaatacaactatatataaaataaaatacaaacttaaataaatacaaaaataaaccaaatcctacctacaatcgcgccttataaacgaaccacgacaaaaaaaatctttctactaacgttaaacaaccgcaacgaaccaataataacacaaaaaacaaacaatcccaaaaaaacaaaacaacaacgacaaccacaaacgcctaccaccccgattactctcaatctttatttaactcattctaaaaaaaataaaattttactaaaaatcttcctcttttaactaactactaaactaaaaaacgacaaaaataaaaaaatccgtattaaaaaaaaaaacacaaaatttattcgaaaatcgacaaaacaaaaaacaaaaacaaaacaaaaaaacacaacaaaaatactctaattctctctaaaaaatttaatcccccaaacaacaaactacaatacaaccaaatctataattttcgaaccgaaccgactccgaaccacaaaaccgcctaaatcgaccgctaccgaatttcacatttctccttcccaaaataaaaaaaacaaaaaatttaaaaaacaaaaaacaaaaaaaacgaaccgtcccaacaacgtaaaccaaacaaacaataatctccctacctccaaaacttacatcgaaaaatccgaaaacatttatttttaatttttttcttcaaataaaaaaaaaataaaacttccccaattaataaacgaaaccatcttttattaaatatattctcctaactctaaacacaactttttaaaaacccaacaaaaactctaacgcaaatcttccaaaaaaaaaaataaaaaatactaaaacttttaattttcatatttaaatttaacaaactccaaaaccacaatacttccccgattacccgataaattttttttcctttttttttttttaaatactctcttaaaaaattccaccgatctttcaaacaaaacattaaccaaccgccgaaacccgaaaatacccgaaacgacgaaactaataacgaaaaaaacgcaacctccctccgcgcccgcccgcgatataaaccgaatacaaaccgtaaaaccaaactaccccgactcccgctaaatcccaacccccgccccgcctaataaaccccgcgacaaacgacttctaaacaacttcaaaaaaattcgcgaaacaaacacacgtattaatccgtccctttctcgaacaacgcgatcccgccatcaatcctatccgacgcgtctaaccataaactacacgacaatcgaacgaaaaacgcgaaaaacgaacgcaccgacctataaaaaaaaaccaaaaaatctacgctaccgacgcccgatcgcacctccgccccgaaccctttccgcgataaatttaaacaaaaaacgctaaaactccgaaaaaaaacgaacccaataaaaaacgcgcaaaaaaacaacttcaaaccaaaaaaatacaaaatcacaaaaatcaaaaaaataaacacaaaaaaacataaactaaaaaaacaaaaaaaaacgacaaaaacttaaaaaaacgaaaaaacacaaaaaaaccctaaacgctaactccaaaaacgaacccaaaaaatataaaatcaaactaacgacgacgtcgtcgactacgaccgaaaccgacgtcgcgcgtccctacatcctcgcatccgtctacaccgacatacgataaactctcaaaaatcgaaacgcgaatacaacgcgccgatcttactatcgtaatcccaataaaaacaatacatcataacgaactcgaactaccgaacacaaacgaactacaaacccgacgcactaataaacgcgaacgccgaaaacgcgacgataactaaactaacaaaactaaactaacccgacgacgacgcgacgaccccgtaatacgataaaacaaacgacgatacgacgaccgcgtacaaataatatacgtacgaatacgaataaaaatacgacgaaaacgaaaatacgaccgacgaacctcccaaaccattatacgaattcactacgccgaaaaacaacgccatactctacacgcgtatatacgacccgtacgaaacgaccgaacccgccaaccccttaaccacaacgaccgcgccaaaactaccgaaacccgcgactacaaccgcaactactacaaccgctacgactaccgccatctaacaaaaaacataaaacataaataaaaaaaactacgataacgaccacgaattattaaaaaaaccaaactacaaatacttaaaaaacgccaaataaccgtaaccgtcgaccccgacgcccgccacgccgcacccgcctacgacgcctccgaccccgaaaaaccccttaccgaactaaaaatacgcgaacgacgaccgaaaaaacctcttcatacgacgacgacgccgataattacccttctcgaacatatcttcgcaaaccgaatccaacgtccaataattacccttacgctcgccgccgccctcgcgcgacaccttaataaaacactcgttaaaactaaaattataacgaatactattttaccaacccttcttattcttctcgtaaaacgaaaacttcgcgataatatactaataaataccgaacaacgtaaacctcttctccgcgctctcgcgaatcgccataacgataaacgccacgtacgaatacgaaaacttctacgccgaatccgacttctccgaaactatcccgccgccacccccaccgcccttacctaaactcgacgacgacccttctaactccttaactatacgaccgatctctaaaaccaacaaaacccccgccgcgtcctcgaactcgaaataactaaccatcataacaaaaccgacgcgccgcgaccgaaccgcctctactctccgctccaaacgctaacgcgacaaaaaattaaaacgcacgaatccgcttacgaccaaatctcaaacttctaaaaactacgaataccgcccgcgcttacttactaaaaacctatcgctactctcccctctccttccccttcccctaaaaaacgaccgacgaaaataaaactcaacctctaaccataaaaaatccgcccaacaaaaaaaaactccgacctcgccgcccctccccgctcaaaccaatccccgccttaataaattttcttttctacgctcttcccctccccccgccccccgatttcccgaaacacgacccgcgtctctaacgaaactacctcctaaaatccctaatacgccaaaaacctcgctctattctaattcgtataaactccaccgaattccgcttacgtcaaacgccttcgcccctataacgaaacgaccaaccgcgcacgaacgaattcatctccaaatcactttttataaacgccccgcacaacctaaaccgacctacccccgcccaacgaacctcaaaaacccaaccgacaaccaaactcacgcgcccttaaaatctaccgatactcgctctacgaactaaactaaaaaataacgaaaaccccgataaaatctacccgcacccgaccaaaacccaaaaaactcgaaccccaacgaaaaaaaacgctccaaacctcctcgcgactttcaaataaaaaaaaacgactcctttactctaccgtttactaccgtcttaaaactaaacttctaactcgaaactaaaaaaaaacgaaacgacgaaaaaactaaacgaaataaaataaaaaaaactactctaaaactttaaaaaaatcaacccaaaaacgaatataactatacgaaaaaacctcgacctaacctatccctcgcgctctcaaaataactaaactaaaataaaacaaaaaaaaaaatctctaaaaataatcgtcaaaaacgccgcctaaatcacctctacctctccctacgttaccaataaatctaaaaaccaaaaatccgtatactaatcctacgaaattaaaataaaaattaaatatatactttaacaacaccaaataaatacccctcaactattacactaacacaaacgaaactattacccgaaactttacgaaactatatatatatatacacaaaaatcacatataaaaatcataaaaaaaaactatccttaaaataaataaaataccaaatacatatatactactcaaaaacacaaatatacacatatacaaaatataaaatttatatttacgaaataaaacacacttatactaataattatataatatattcatcaaatattaaaataaatataactaataaatataacatcttctctttttctcctttcttacttctttccttcccccctttcttcctttctttcacaattcttcgatacctctttccctcccaatatatatattttaccacaaactaaaaaaacaaacatcaaactaaaaaaaaaacttattcaaatctctctcctaataaaacatttattctaatctttctccaaaaaatcaaaaattaattatcacctaccttaaacaaaattctaataaaaatccaattatttcaacatatacaaaaattatttcaaaaaaaatcaaatataccttttaacaatatactccttaacaataccttttaacttaacctaaacaaaaaatctacaatcataaaatataaaaaaaataaccaatattttaaatcctcaaaccccaaactccttaatactaaaaaaaaaaacaaaaccaccttataaaaaaaaataaactaaataaatatcatataactatacattaataattaacatatctaaaataactaactcaatacctatcactacctcttcctcccaaactatttaaactctaaaaattctcctaaaacccaaaaaaccttcaacgacctataattccaacatccacaaaccatctacaaatattatctactactcactcaaacctctaatctacattctaaaataaaaaaaaaaaaaaacaaaaataataaaactctttaaaattcaacatcttaaaaataacaccaaaaaaatcaacaaaacaacccttacctaatcacaaaaataaaaaaaaacaaaactatccccaaaataacttaattttttttataaacgatctcccactacacccaacaaacataaaaaaaacaacacttccgcaaaatccctactactactttctaaacaaaaatacaaatatttttcttcttccttacccccatccttacccaaactttaaataaaaataataaatccgatttaaaactactacaaattaacctcaatacctatcctcccccaaccaaaacctaaacaaaaaaaaaaacaactaaatctaaccccatcctaataaaaactcctctctccttttctctcctttttttttttcttaaccacccaaactaactctctacgtctctctatctttctttcttcttctcacaaacatttccgctactcaaccctacaacaaccaaatataacaacattattatatatatcatcacttccctaaattccacactcgactcccttttcaacctttaaaaaacctatatatatatacatatacgtatatatatatatatatatatatataaaaattaaaaacaaataaaaaaattcctctaaaaaattttcaaaataaaaaaaaattctactctaaaaatactaatttctaactatcccgtaaaaaaacaaaatccccaaccctaataaaaaaaaaaatacctaatacgtacaccctaaaaaaaactaaaatcgatctccccaaaatataccttcacataactatccgacattcgaaaactcaaaaaacaaacaaaaaaatacgaacgaaaaaactaacaaaataattactttcaaatcccctccaaacttctacgaaaaaaccaaaaacttcgaactaaaaataaaaaaatctaaaaaaaaaacaaaatcctctccttaccgacccaaccaaaaataaataaaccgaacgctccaaaaaacgatacgaaacgccctaatttacttctcaaccttcgaaaataaactaattactaacgaaatcgaaatcctctctaaacaaaacatactatacctaaattttataaacgccaaaaccgattccttttctccccgcgacattaaaacgacgcaaaacccccgacttaataaccttaaaacgacgctcacctccaaaaaccaaaataataaactaaacaaaactcactacctctttaccccaattttccaaaatcccgcaactacaattcaacaaccaccgacgcctcctaaccgtaatcccaccgtaacgccgcctacgaatacgattccaataaaccgccgattaaacgcaatctcaactcccgcgcctcctcgcaacctaaccccgcgcctcgaaaatcccgacaaccgacgcgaacaatctacacgactctaatacaaacgcttttctccccaaaaccgaaaatcctacaacaacgacaaaaaccgcccgcgcctcgaacttccgacgacccaactctactaaaaaaacgtcgcgactactctaaaacaaacaacgcttcgctaaaaccactcaactcgtcccgcgccgccgccgactacctaaaccaaattccgctatcccctttcctaacgaaaccccgaaacacccgacgacttcccgctcctaaacgaaaaaaaataaaacttactacaaccctctacttaaaaaaataacctctacgatacttaactaacaaaaaaaaacttcactatatctattaatacatccccatacactccacgcctcaacaactatcaacactcactccctcccgacccctcacaaaaccctttacacccacacctcaaaaactcgatatccctccactcaaatcacgttactccatccacttctctctccttctccctctatcaactccaaatcccctctaattctccctcccctcctacttctctcacactcaccaactacacgtactaattcaaattttacacatattaataaaaaacatatcaaaccaatatacaaaccctaaaacttttcacacgctactcactttcgcatctcacgatacaaaaaaaccaataaactccaaatttacaaacctaactccgaaaaacctattaattctctaatatccttaacctataattcgaataactaaactaccacctaaatattttcataataaaactaccgcacaaaccacaaaaaaactcaaatactaaacacgttccaaatacactttaacatacacaaaccactcacacaaactttatctctatctcgaaactctactaaatttactactcaaaccaacaaaatacaacaacaaacacccacataacaccaaatctaaaaccaataaatattaatctacctaattaaaattaacaaaatcaattactcacatatatacttaaaaaaaaataaaaaaataaaaaaaaaaaaaaaaatattaaaaaaaaaaaaaaaaaaacgacctcctactctaaaaaaaactcacacataaaaactatttcctattattaaatatctcactaaactcccctctttctcccccaaaaaaaacttaaaaaacaataaaccaaaactctaaactcctctttaccttactaatattaaaatataaatcctccaacaccattttatcccaaaaaatatataccccatcgtcaatcaaacaaaatacaaaacaattatcgacctttttcataataaaaaccaactaaaaaaaaaacaaaaaaatctaaatcctaaaccaaataaaaccctcttccctccaaaaacccgtaaaatactctcaaaaacgaattctaaaataataaaaactactaacaaatttcctctaatatccctcataacatctataacccaaaaccattttattcaactctaaacaataaataccttaccaataaacctcaaacttactaaaaaacataatatattcttaaaaattaccttattacctttctccacacccaaactataaacgctaataaacaaaaactctaccctccacttctcactcaatactccccaccaaaataaacttaataccttttaataaaattaaaaaataattctactaaacaaaattaaaaaataccactttccttataataaaattataataaaattaaaatttccaaaaaaaaaactataactaaaaaaaaacgatttaatcattaacaaccaactcaaaatctaaaaattctttaccatttaaaattattataactacataaccataatactaaaccttaaacaaaaacaaaaacacctccctaattcccaatcataataaaaacctatctaaaacatt

SEQ ID NO: 5 - DNA, 12917 bp, Artificial Sequence
  bisulfite converted genomic DNA
aatgttttagataggtttttattatgattgggaattagggaggtgtttttgtttttgtttaaggtttagtattatggttatgtagttataataattttaaatggtaaagaatttttagattttgagttggttgttaatgattaaatcgtttttttttagttatagttttttttttggaaattttaattttattataattttattataaggaaagtggtattttttaattttgtttagtagaattattttttaattttattaaaaggtattaagtttattttggtggggagtattgagtgagaagtggagggtagagtttttgtttattagcgtttatagtttgggtgtggagaaaggtaataaggtaatttttaagaatatattatgttttttagtaagtttgaggtttattggtaaggtatttattgtttagagttgaataaaatggttttgggttatagatgttatgagggatattagaggaaatttgttagtagtttttattattttagaattcgtttttgagagtattttacgggtttttggagggaagagggttttatttggtttaggatttagatttttttgttttttttttagttggtttttattatgaaaaaggtcgataattgttttgtattttgtttgattgacgatggggtatatattttttgggataaaatggtgttggaggatttatattttaatattagtaaggtaaagaggagtttagagttttggtttattgttttttaagttttttttgggggagaaagaggggagtttagtgagatatttaataataggaaatagtttttatgtgtgagttttttttagagtaggaggtcgtttttttttttttttttttaatatttttttttttttttttatttttttatttttttttaagtatatatgtgagtaattgattttgttaattttaattaggtagattaatatttattggttttagatttggtgttatgtgggtgtttgttgttgtattttgttggtttgagtagtaaatttagtagagtttcgagatagagataaagtttgtgtgagtggtttgtgtatgttaaagtgtatttggaacgtgtttagtatttgagtttttttgtggtttgtgcggtagttttattatgaaaatatttaggtggtagtttagttattcgaattataggttaaggatattagagaattaataggtttttcggagttaggtttgtaaatttggagtttattggtttttttgtatcgtgagatgcgaaagtgagtagcgtgtgaaaagttttagggtttgtatattggtttgatatgttttttattaatatgtgtaaaatttgaattagtacgtgtagttggtgagtgtgagagaagtaggaggggagggagaattagaggggatttggagttgatagagggagaaggagagagaagtggatggagtaacgtgatttgagtggagggatatcgagtttttgaggtgtgggtgtaaagggttttgtgaggggtcgggagggagtgagtgttgatagttgttgaggcgtggagtgtatggggatgtattaatagatatagtgaagtttttttttgttagttaagtatcgtagaggttatttttttaagtagagggttgtagtaagttttattttttttcgtttaggagcgggaagtcgtcgggtgtttcggggtttcgttaggaaaggggatagcggaatttggtttaggtagtcggcggcggcgcgggacgagttgagtggttttagcgaagcgttgtttgttttagagtagtcgcgacgtttttttagtagagttgggtcgtcggaagttcgaggcgcgggcggtttttgtcgttgttgtaggattttcggttttggggagaaaagcgtttgtattagagtcgtgtagattgttcgcgtcggttgtcgggattttcgaggcgcggggttaggttgcgaggaggcgcgggagttgagattgcgtttaatcggcggtttattggaatcgtattcgtaggcggcgttacggtgggattacggttaggaggcgtcggtggttgttgaattgtagttgcgggattttggaaaattggggtaaagaggtagtgagttttgtttagtttattattttggtttttggaggtgagcgtcgttttaaggttattaagtcgggggttttgcgtcgttttaatgtcgcggggagaaaaggaatcggttttggcgtttataaaatttaggtatagtatgttttgtttagagaggatttcgatttcgttagtaattagtttattttcgaaggttgagaagtaaattagggcgtttcgtatcgttttttggagcgttcggtttatttatttttggttgggtcggtaaggagaggattttgttttttttttagatttttttatttttagttcgaagtttttggttttttcgtagaagtttggaggggatttgaaagtaattattttgttagttttttcgttcgtatttttttgtttgttttttgagttttcgaatgtcggatagttatgtgaaggtatattttggggagatcgattttagttttttttagggtgtacgtattaggtatttttttttttattagggttggggattttgtttttttacgggatagttagaaattagtatttttagagtagaatttttttttattttgaaaattttttagaggaatttttttatttgtttttaatttttatatatatatatatatatatatatacgtatatgtatatatatataggttttttaaaggttgaaaagggagtcgagtgtggaatttagggaagtgatgatatatataataatgttgttatatttggttgttgtagggttgagtagcggaaatgtttgtgagaagaagaaagaaagatagagagacgtagagagttagtttgggtggttaagaaaaaaaaaaaggagagaaaaggagagaggagtttttattaggatggggttagatttagttgtttttttttttgtttaggttttggttgggggaggataggtattgaggttaatttgtagtagttttaaatcggatttattatttttatttaaagtttgggtaaggatgggggtaaggaagaagaaaaatatttgtatttttgtttagaaagtagtagtagggattttgcggaagtgttgttttttttatgtttgttgggtgtagtgggagatcgtttataaaaaaaattaagttattttggggatagttttgtttttttttatttttgtgattaggtaagggttgttttgttgatttttttggtgttatttttaagatgttgaattttaaagagttttattatttttgtttttttttttttttattttagaatgtagattagaggtttgagtgagtagtagataatatttgtagatggtttgtggatgttggaattataggtcgttgaaggttttttgggttttaggagaatttttagagtttaaatagtttgggaggaagaggtagtgataggtattgagttagttattttagatatgttaattattaatgtatagttatatgatatttatttagtttatttttttttataaggtggttttgtttttttttttagtattaaggagtttggggtttgaggatttaaaatattggttattttttttatattttatgattgtagattttttgtttaggttaagttaaaaggtattgttaaggagtatattgttaaaaggtatatttgattttttttgaaataatttttgtatatgttgaaataattggatttttattagaattttgtttaaggtaggtgataattaatttttgattttttggagaaagattagaataaatgttttattaggagagagatttgaataagttttttttttagtttgatgtttgtttttttagtttgtggtaaaatatatatattgggagggaaagaggtatcgaagaattgtgaaagaaaggaagaaaggggggaaggaaagaagtaagaaaggagaaaaagagaagatgttatatttattagttatatttattttaatatttgatgaatatattatataattattagtataagtgtgttttatttcgtaaatataaattttatattttgtatatgtgtatatttgtgtttttgagtagtatatatgtatttggtattttatttattttaaggatagtttttttttatgatttttatatgtgatttttgtgtatatatatatatagtttcgtaaagtttcgggtaatagtttcgtttgtgttagtgtaatagttgaggggtatttatttggtgttgttaaagtatatatttaatttttattttaatttcgtaggattagtatacggatttttggtttttagatttattggtaacgtagggagaggtagaggtgatttaggcggcgtttttgacgattatttttagagatttttttttttgttttattttagtttagttattttgagagcgcgagggataggttaggtcgaggttttttcgtatagttatattcgtttttgggttgatttttttaaagttttagagtagttttttttattttatttcgtttagttttttcgtcgtttcgtttttttttagtttcgagttagaagtttagttttaagacggtagtaaacggtagagtaaaggagtcgtttttttttatttgaaagtcgcgaggaggtttggagcgttttttttcgttggggttcgagttttttgggttttggtcgggtgcgggtagattttatcggggttttcgttattttttagtttagttcgtagagcgagtatcggtagattttaagggcgcgtgagtttggttgtcggttgggtttttgaggttcgttgggcgggggtaggtcggtttaggttgtgcggggcgtttataaaaagtgatttggagatgaattcgttcgtgcgcggttggtcgtttcgttataggggcgaaggcgtttgacgtaagcggaattcggtggagtttatacgaattagaatagagcgaggtttttggcgtattagggattttaggaggtagtttcgttagagacgcgggtcgtgtttcgggaaatcggggggcggggggaggggaagagcgtagaaaagaaaatttattaaggcggggattggtttgagcggggaggggcggcgaggtcggagtttttttttgttgggcggattttttatggttagaggttgagttttattttcgtcggtcgttttttaggggaaggggaaggagaggggagagtagcgataggtttttagtaagtaagcgcgggcggtattcgtagtttttagaagtttgagatttggtcgtaagcggattcgtgcgttttaattttttgtcgcgttagcgtttggagcggagagtagaggcggttcggtcgcggcgcgtcggttttgttatgatggttagttatttcgagttcgaggacgcggcgggggttttgttggttttagagatcggtcgtatagttaaggagttagaagggtcgtcgtcgagtttaggtaagggcggtgggggtggcggcgggatagtttcggagaagtcggattcggcgtagaagttttcgtattcgtacgtggcgtttatcgttatggcgattcgcgagagcgcggagaagaggtttacgttgttcggtatttattagtatattatcgcgaagttttcgttttacgagaagaataagaagggttggtaaaatagtattcgttataattttagttttaacgagtgttttattaaggtgtcgcgcgagggcggcggcgagcgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcggttgtagtcgcgggtttcggtagttttggcgcggtcgttgtggttaaggggttggcgggttcggtcgtttcgtacgggtcgtatatacgcgtgtagagtatggcgttgtttttcggcgtagtgaattcgtataatggtttgggaggttcgtcggtcgtattttcgttttcgtcgtatttttattcgtattcgtacgtatattatttgtacgcggtcgtcgtatcgtcgtttgttttatcgtattacggggtcgtcgcgtcgtcgtcgggttagtttagttttgttagtttagttatcgtcgcgttttcggcgttcgcgtttattagtgcgtcgggtttgtagttcgtttgtgttcggtagttcgagttcgttatgatgtattgtttttattgggattacgatagtaagatcggcgcgttgtattcgcgtttcgatttttgagagtttatcgtatgtcggtgtagacggatgcgaggatgtagggacgcgcgacgtcggtttcggtcgtagtcgacgacgtcgtcgttagtttgattttatattttttgggttcgtttttggagttagcgtttagggtttttttgtgttttttcgtttttttaagtttttgtcgtttttttttgtttttttagtttatgtttttttgtgtttatttttttgatttttgtgattttgtatttttttggtttgaagttgtttttttgcgcgttttttattgggttcgttttttttcggagttttagcgttttttgtttaaatttatcgcggaaagggttcggggcggaggtgcgatcgggcgtcggtagcgtagattttttggtttttttttataggtcggtgcgttcgtttttcgcgtttttcgttcgattgtcgtgtagtttatggttagacgcgtcggataggattgatggcgggatcgcgttgttcgagaaagggacggattaatacgtgtgtttgtttcgcgaatttttttgaagttgtttagaagtcgtttgtcgcggggtttattaggcggggcgggggttgggatttagcgggagtcggggtagtttggttttacggtttgtattcggtttatatcgcgggcgggcgcggagggaggttgcgtttttttcgttattagtttcgtcgtttcgggtattttcgggtttcggcggttggttaatgttttgtttgaaagatcggtggaattttttaagagagtatttaaaaaaaaaaaaaggaaaaaaaatttatcgggtaatcggggaagtattgtggttttggagtttgttaaatttaaatatgaaaattaaaagttttagtattttttatttttttttttggaagatttgcgttagagtttttgttgggtttttaaaaagttgtgtttagagttaggagaatatatttaataaaagatggtttcgtttattaattggggaagttttattttttttttatttgaagaaaaaaattaaaaataaatgttttcggatttttcgatgtaagttttggaggtagggagattattgtttgtttggtttacgttgttgggacggttcgttttttttgttttttgttttttaaattttttgttttttttattttgggaaggagaaatgtgaaattcggtagcggtcgatttaggcggttttgtggttcggagtcggttcggttcgaaaattatagatttggttgtattgtagtttgttgtttgggggattaaattttttagagagaattagagtatttttgttgtgtttttttgttttgtttttgttttttgttttgtcgattttcgaataaattttgtgtttttttttttaatacggatttttttatttttgtcgttttttagtttagtagttagttaaaagaggaagatttttagtaaaattttattttttttagaatgagttaaataaagattgagagtaatcggggtggtaggcgtttgtggttgtcgttgttgttttgtttttttgggattgtttgttttttgtgttattattggttcgttgcggttgtttaacgttagtagaaagattttttttgtcgtggttcgtttataaggcgcgattgtaggtaggatttggtttatttttgtatttatttaagtttgtattttattttatatatagttgtattaggtgtatgggttggttgtgtttttattattgtttttaaatttttcgattttgagttaattataatagttaagagtttgttttaaatattaatagataaaattttggttgtggaaatgcgttgtaaattgttaatttttgtataaatgtgagaagtgattgttttattatttttaatagttagaatttatttattttgagatatgggtaggagatttggaggttttagtaaggattgaatatatttcgcggttgtagaaatttagttttttttttttttttttttttttttattgagatttttaaataacgaattaagatttatgttttcgcgtaggtatataggcgtttgatttggttgtagtttggtttttttaggcggattagggggtggtcggtttttatttttttgatgggatagatgattttcgatttttgataggatagattcgtcggtttttgcgggttgttgtttagttgagattagatttcgtatttagtttttattgtttttttttcgtttatttcggggtttggttagtaatgtggcggtaggtttaggtcggttggtgggttaggagcggttttgcgttacgggaatgagtttgtaggttttttattttagttttttagtggttaggcggtaggaattttagggtggtattttgttatgtatagttgggtttaagtggtttttgtttagaatgtttttcgttttttataggtattttgcgagaggttataaggtaggagattaagttacggggatttttagggggtattattttaagattgggattggagtttattaggaatcggtaggagtaggatggagagggaggtttagttggagtaggaagttttagaggttggttaggtttggtgtttgggtgtttttggtgttcggttgttttattatttggttaaggggagttgtagaatagaaagtagtttgttgtgtgtatgtttgtttgtgttttgtttagcgtgaaaatttagtttatgggtaagtaattgtgtagtttgtatttgttgtaaatgtgtgtgtatagtgttagttgtgtattggtgatagggtgggaggtgtgtgtgtttgttattcgtttgtagagtgggtatatatttttggtattgtaataattatatggttaatatttaggaagtgtttattgggattatagtgtgtgtggtatttatattttattggtgatgtgtgtatttgtgggtgtgtatttttggtttgttgaaaaataaagtaatatggatagagtttttgttttattaggtagaggttttttgttttgaagttggttgttagtatttttttaattgtcgttttaagtagagaaagtaagggagggaagtttttaggattaagttttggtgggtaggtagtagtttatttttagtgagacggagaagttggtcggggttagtaatgaaggattagtttgtttttttttcgagaattgaaaggtaaaaggtatttaaggttgggaagagagtagtagttttattaagtaaggaagataaaatgaagtaattagtgagggttttttgggtttatatagggattgaaggaggtgagagaagggagttaaattatattttatttttttatggatgtttataggaaaaatttgtttaattttagttttcgggatttttttaaagtttttaagtttggttattttttttagggtcgaaagtttagtttaatggtaggttttttttattttttattttttttttttttttttttttttcgtatttttgagtttttattatagaagttgatttaagtaatttttgagggtaaaagtatttgagttatatagtaattatgttttagtatatatagtttggtttagatggttgggttatgtgagtgtgtgtatatatattggttagtgtgtaaatataatgtaaatagagtttaatataaatatttagttaatttttgaatgttttgggtaatgagtcgtttttgtatgaagattatgtgtgtggtgggtgtaaatattttatatattgttgatagtatgagttttttttttatatttatatagaaatttttagagttatttttattttattaaaattgtttagttagagtaagtgggttggtttggagaaagtagggggaggtgttttgtttttaagagggatttggagaaattttcgttattgaagtatatgtattaagggattgtgggaaagggatttacggagttttggagatggttttgtattttattttagagggtattgacgttttgtttttagtttgtattagtaaatagtttattgttttagatttgaggtttagatgagtaagaggttttggattttttattcgaggttaggtgtatttagtttttgttagggttttttggaagttaaggttggagatggggttgtaaggagttttttggcggcgggtggaaattggggttagatttaggttttatgtagttagataagtagaatatgggttaggaatttgagtttggtttaagatagtttgtttttaattgagtttttttttttatgaaggtttgggttaggttttatggataggattatcggattagatttttggtttttgggtgggggtttaaggttaggaaatattttgattaggtttagtatttttgtagtgtttttattttgtagatttaatttggtggtgattttggggttttgttcgttaggtttattattattgtgtggtagtttttattttttggagtagattgtgggatttatagaaaagatggggaaaggatgggattaagagttttatgttttcgggataattaggaattaaggatttttaaaatcgagtagttttagtaattttttattttttggagagaggatttttagttgttataaaaagagtgttttgggtttaggaatttaaaattatattatatttgaggaattttaggttttaagaagagaagagattaattagaggttttttaggtatttgtgaggtaaatggttttcgaaatttttaaaggagatttgatagtagttgagtttagttgttattgatgtttaagggagttgcgtagtaagggagagttttttaggagtagtaagggagagttttttaggagaagaaggaagtatagtttgagttgtgttttttgttttttttgtttgtttttgtattatagaaattgttgttgtataggttgtttgtcgtataggtttggtgttgagttgtgaaaagtatgttttgggattttgttatttcgcggaggtggtttgtgtagtatgaggtaaagatttggtttgtttagttaggaagaattgggttggagtttggtgttttttttaatagttatgtaattttgggtaaaatatttatttaaattttagtgtttttttttataaaatagaaatacgtgcgtgtattagaattattaaaataattaaattttttaatttttaagtgtttagtttatagtagatgtttaataatgttttttttttttttttattaaaaaaaaaaaaggaaggaaggaagtaaaaaaggaaagaagaaaggaagggggaaaaaaaatttttagtaataattttttaggatttgattttttaatttagttggttataggtattttttgcgagtatttttcggggttaggcgtacgcgattgtatttattttgttttagttttttggtcgtgggagtgaggtttacgcggttgtcgttgtagcgaatatttaagttttgaaggtatagttggtgggcgttgagatttcgttcggggtttttttaatttttttttcgttttttttaaagcggtttttatacgtttaggaggttttttttgagaaaggtcgtgttgattcgcgaagcggtatcgatttagggatttatttataggttgttcggttggcgtttttagtttttacgcgtttttttcgattggttgatttttttttttttttttttttttttttttttttttttagaaaagtagaaggtagttatcgggttagaggttgtagggttagtttgtgggcgaggtttttttaggtttttgtggagaaacgggaaatttgaggggtaaacgtaggaagcgggttgggttaattgcgggcgatcgaggcgtcgttagcgggtggggagcgagaggggttagtagtcgggaagatttcggtttggagcgtttcgtgttttcgggtttgttggcggcgttgtaagtttaggttttggggcgcgagttaagttttttttgttagttttaaataaaattcgggggagaatgagtcggttagtttgggtatagggtgttttcgattgtcgggcggcgggcggaagcgtaggggttttgatcgtttttagaggtgttgagcgtatagggtagtggttgtagagtttcggcgcgaggttaattcggattatttacgttgggattttagtttgttcggttgtttttagtaataataatagtatgaaatcgagttttaaaaaattttttttcgtatttttttttatgtataagggagaataagtatttttaggtagttaaagaaaaaaaaagggtaggattttaggaaattttaatttttatggacgaggagtgaaggggaattcgttttttgttttttttgtttgtttgtttttagaagagaaaaaaaggaaattcgatatatattttt

SEQ ID NO: 6 - DNA, 2917 bp, Homo sapiens
ttaaaagaaggaacacaaaatttattcgggaatcgacaaggcaaaaaacaaaaacaaaacaaaaaaacacaacaaaagtgctctagttctctctagaaaatttggtcccccaaacaacaagctacagtacaaccaggtctatggttttcgggccgggccggctccgggccacaagaccgcctaggtcggccgctgccgggtttcacatttctccttcccaaggtgggagaagcaggaggtttgaaaaacaaaaagcagggaggacgagccgtcccagcagcgtgggccaggcaggcagtgatctccctgcctccaggacttgcatcgaaagatccggggacatttgtttttgatttttttcttcagatagggagagggtgaaacttccccaattggtagacgaaaccatcttttattggatatattctcctaactctgaacacagctttttgaaggcccaacaaaaactctaacgcaaatcttccagaagagaagatgaggaatactaaagcttttgattttcatatttggatttagcaaactccaaggccacaatacttccccggttgcccggtgaattttttttcctttttttttttttaaatactctcttaaaaagttccaccgatctttcaaacaaaacattagccagccgccggggcccggaggtgcccgaagcgacgggactgatagcggaggaaacgcagcctccctccgcgcccgcccgcggtgtaaaccgagtacaggccgtggagccaggctgccccggctcccgctgggtcccaacccccgccccgcctagtgggccccgcggcaagcggcttctgaacagcttcaagagggttcgcggagcaaacacacgtattggtccgtccctttctcgggcagcgcggtcccgccatcagtcctgtccggcgcgtctagccatggactgcacggcagtcgggcggggaacgcggagagcgagcgcaccgacctgtgagagaaggccaagaggtctgcgctgccgacgcccggtcgcacctccgccccgggccctttccgcggtgaatttgggcaggagacgctggggctccggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgtcgcgcgtccctgcatcctcgcatccgtctgcaccggcatgcggtgggctctcagagatcgaggcgcgaatgcagcgcgccggtcttgctgtcgtggtcccagtaagagcaatgcatcatggcgagctcgggctgccgggcacaagcgaactgcaggcccggcgcactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggggtgcggccggcgggcctcccaggccattgtacgagttcactacgccggggggcagcgccatgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacagcgtgagcctcttctccgcgctctcgcggatcgccatggcgatgagcgccacgtacgagtacgggggcttctgcgccgggtccggcttctccggggctgtcccgccgccacccccaccgcccttgcctgggctcggcggcggcccttctggctccttgactgtgcgaccggtctctggggccagcagggcccccgccgcgtcctcgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgat

SEQ ID NO: 7 - DNA, 2917 bp, Artificial Sequence
  bisulfite converted genomic DNA
ttaaaagaaggaatataaaatttattcgggaatcgataaggtaaaaaataaaaataaaataaaaaaatataataaaagtgttttagttttttttagaaaatttggttttttaaataataagttatagtataattaggtttatggttttcgggtcgggtcggtttcgggttataagatcgtttaggtcggtcgttgtcgggttttatattttttttttttaaggtgggagaagtaggaggtttgaaaaataaaaagtagggaggacgagtcgttttagtagcgtgggttaggtaggtagtgatttttttgtttttaggatttgtatcgaaagattcggggatatttgtttttgatttttttttttagatagggagagggtgaaatttttttaattggtagacgaaattattttttattggatatatttttttaattttgaatatagttttttgaaggtttaataaaaattttaacgtaaattttttagaagagaagatgaggaatattaaagtttttgatttttatatttggatttagtaaattttaaggttataatattttttcggttgttcggtgaatttttttttttttttttttttttaaatatttttttaaaaagttttatcgattttttaaataaaatattagttagtcgtcggggttcggaggtgttcgaagcgacgggattgatagcggaggaaacgtagttttttttcgcgttcgttcgcggtgtaaatcgagtataggtcgtggagttaggttgtttcggttttcgttgggttttaattttcgtttcgtttagtgggtttcgcggtaagcggtttttgaatagttttaagagggttcgcggagtaaatatacgtattggttcgtttttttttcgggtagcgcggtttcgttattagttttgttcggcgcgtttagttatggattgtacggtagtcgggcggggaacgcggagagcgagcgtatcgatttgtgagagaaggttaagaggtttgcgttgtcgacgttcggtcgtattttcgtttcgggtttttttcgcggtgaatttgggtaggagacgttggggtttcggaaagagacgagtttagtagaaagcgcgtagagaggtagttttaggttaggggagtgtaaggttatagaggttagggaggtgagtataggaggatataaattgaggggataaagaggagcgataggagtttaggaaagcgaaaaagtatagagggattttgggcgttggttttagaggcgggtttagagggtgtgaggttaggttggcggcggcgtcgtcggttgcgatcggggtcggcgtcgcgcgtttttgtattttcgtattcgtttgtatcggtatgcggtgggtttttagagatcgaggcgcgaatgtagcgcgtcggttttgttgtcgtggttttagtaagagtaatgtattatggcgagttcgggttgtcgggtataagcgaattgtaggttcggcgtattggtgggcgcgggcgtcgggggcgcggcggtggttgggttggtagggttgagttggttcggcggcggcgcggcggtttcgtggtgcggtggggtaggcggcggtgcggcggtcgcgtgtagatggtgtgcgtgcggatgcgggtgggggtgcggcggaggcgggggtgcggtcggcgggttttttaggttattgtacgagtttattacgtcggggggtagcgttatgttttgtacgcgtgtgtacggttcgtacgaggcggtcgggttcgttagttttttgattatagcggtcgcgttagggttatcggggttcgcggttgtagtcgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcgttcgtcgtcgttttcgcgcggtattttgatgaagtattcgttgaggttgaggttgtggcggatgttattttgttagttttttttatttttttcgtagaacgggaatttcgcgatgatgtattggtagatgtcggatagcgtgagtttttttttcgcgttttcgcggatcgttatggcgatgagcgttacgtacgagtacgggggtttttgcgtcgggttcggttttttcggggttgtttcgtcgttatttttatcgtttttgtttgggttcggcggcggtttttttggttttttgattgtgcgatcggtttttggggttagtagggttttcgtcgcgttttcgggttcggggtagttggttattatgataaagtcggcgcgtcgcggtcgggtcgtttttgtttttcgttttaggcgttggcgcggtaaagagttggggcgtacgagttcgtttacggttaagttttaaatttttggagattgcggatgtcgttcgcgtttgtttgttggaggtttgtcgttgttttttttttttttttttttttttttagggagcggtcggcgggagtggagtttagtttttggttatggggagttcgtttaatagagaggggtttcggtttcgtcgttttttttcgtttaggttagttttcgttttggtgggtttttttttttgcgtttttttttttttttcgtttttcggtttttcgaagtacgattcgcgtttttggcggagttgttttttggagtttttagtgcgttaggagtttcgttttgttttgat

SEQ ID NO: 8 - DNA, 2917 bp, Artificial Sequence
  bisulfite converted genomic DNA
atcaaaacaaaacgaaactcctaacgcactaaaaactccaaaaaacaactccgccaaaaacgcgaatcgtacttcgaaaaaccgaaaaacgaaaaaaaaaaaaaaacgcaaaaaaaaaaacccaccaaaacgaaaactaacctaaacgaaaaaaaacgacgaaaccgaaacccctctctattaaacgaactccccataaccaaaaactaaactccactcccgccgaccgctccctaaaaaaaaaaaaaaaaaaaaaaaaaacaacgacaaacctccaacaaacaaacgcgaacgacatccgcaatctccaaaaatttaaaacttaaccgtaaacgaactcgtacgccccaactctttaccgcgccaacgcctaaaacgaaaaacaaaaacgacccgaccgcgacgcgccgactttatcataataaccaactaccccgaacccgaaaacgcgacgaaaaccctactaaccccaaaaaccgatcgcacaatcaaaaaaccaaaaaaaccgccgccgaacccaaacaaaaacgataaaaataacgacgaaacaaccccgaaaaaaccgaacccgacgcaaaaacccccgtactcgtacgtaacgctcatcgccataacgatccgcgaaaacgcgaaaaaaaaactcacgctatccgacatctaccaatacatcatcgcgaaattcccgttctacgaaaaaaataaaaaaaactaacaaaataacatccgccacaacctcaacctcaacgaatacttcatcaaaataccgcgcgaaaacgacgacgaacgcaaaaacaactactaaacgctaaacccgacctacgaaaacatattcgaaaaaaacaactaccgacgccgccgccgcataaaaaaacccttccgaccgccgcccgcgcacttccaacccgacaaaaaactcttcgaaaccgaaaacgccgcaaacgaatacgacgtaacgaacgccgaaaccgacgactacgactacctaacgccccccaaatacctacaatctaacttcctcaacaactcgtaaccgctaccgcaacctccctcacccataccctatacctcctaccaaataacgacaaccgcaacgactacaacaactacgactacaaccgcgaaccccgataaccctaacgcgaccgctataatcaaaaaactaacgaacccgaccgcctcgtacgaaccgtacacacgcgtacaaaacataacgctaccccccgacgtaataaactcgtacaataacctaaaaaacccgccgaccgcacccccgcctccgccgcacccccacccgcatccgcacgcacaccatctacacgcgaccgccgcaccgccgcctaccccaccgcaccacgaaaccgccgcgccgccgccgaaccaactcaaccctaccaacccaaccaccgccgcgcccccgacgcccgcgcccaccaatacgccgaacctacaattcgcttatacccgacaacccgaactcgccataatacattactcttactaaaaccacgacaacaaaaccgacgcgctacattcgcgcctcgatctctaaaaacccaccgcataccgatacaaacgaatacgaaaatacaaaaacgcgcgacgccgaccccgatcgcaaccgacgacgccgccgccaacctaacctcacaccctctaaacccgcctctaaaaccaacgcccaaaatccctctatactttttcgctttcctaaactcctatcgctcctctttatcccctcaatttatatcctcctatactcacctccctaacctctataaccttacactcccctaacctaaaactacctctctacgcgctttctactaaactcgtctctttccgaaaccccaacgtctcctacccaaattcaccgcgaaaaaaacccgaaacgaaaatacgaccgaacgtcgacaacgcaaacctcttaaccttctctcacaaatcgatacgctcgctctccgcgttccccgcccgactaccgtacaatccataactaaacgcgccgaacaaaactaataacgaaaccgcgctacccgaaaaaaaaacgaaccaatacgtatatttactccgcgaaccctcttaaaactattcaaaaaccgcttaccgcgaaacccactaaacgaaacgaaaattaaaacccaacgaaaaccgaaacaacctaactccacgacctatactcgatttacaccgcgaacgaacgcgaaaaaaaactacgtttcctccgctatcaatcccgtcgcttcgaacacctccgaaccccgacgactaactaatattttatttaaaaaatcgataaaactttttaaaaaaatatttaaaaaaaaaaaaaaaaaaaaaaattcaccgaacaaccgaaaaaatattataaccttaaaatttactaaatccaaatataaaaatcaaaaactttaatattcctcatcttctcttctaaaaaatttacgttaaaatttttattaaaccttcaaaaaactatattcaaaattaaaaaaatatatccaataaaaaataatttcgtctaccaattaaaaaaatttcaccctctccctatctaaaaaaaaaaatcaaaaacaaatatccccgaatctttcgatacaaatcctaaaaacaaaaaaatcactacctacctaacccacgctactaaaacgactcgtcctccctactttttatttttcaaacctcctacttctcccaccttaaaaaaaaaaaatataaaacccgacaacgaccgacctaaacgatcttataacccgaaaccgacccgacccgaaaaccataaacctaattatactataacttattatttaaaaaaccaaattttctaaaaaaaactaaaacacttttattatatttttttattttatttttattttttaccttatcgattcccgaataaattttatattccttcttttaa

SEQ ID NO: 9 - DNA, 2917 bp, Artificial Sequence
  bisulfite converted genomic DNA
ttaaaaaaaaaaacacaaaatttattcgaaaatcgacaaaacaaaaaacaaaaacaaaacaaaaaaacacaacaaaaatactctaattctctctaaaaaatttaatcccccaaacaacaaactacaatacaaccaaatctataattttcgaaccgaaccgactccgaaccacaaaaccgcctaaatcgaccgctaccgaatttcacatttctccttcccaaaataaaaaaaacaaaaaatttaaaaaacaaaaaacaaaaaaaacgaaccgtcccaacaacgtaaaccaaacaaacaataatctccctacctccaaaacttacatcgaaaaatccgaaaacatttatttttaatttttttcttcaaataaaaaaaaaataaaacttccccaattaataaacgaaaccatcttttattaaatatattctcctaactctaaacacaactttttaaaaacccaacaaaaactctaacgcaaatcttccaaaaaaaaaaataaaaaatactaaaacttttaattttcatatttaaatttaacaaactccaaaaccacaatacttccccgattacccgataaattttttttcctttttttttttttaaatactctcttaaaaaattccaccgatctttcaaacaaaacattaaccaaccgccgaaacccgaaaatacccgaaacgacgaaactaataacgaaaaaaacgcaacctccctccgcgcccgcccgcgatataaaccgaatacaaaccgtaaaaccaaactaccccgactcccgctaaatcccaacccccgccccgcctaataaaccccgcgacaaacgacttctaaacaacttcaaaaaaattcgcgaaacaaacacacgtattaatccgtccctttctcgaacaacgcgatcccgccatcaatcctatccgacgcgtctaaccataaactacacgacaatcgaacgaaaaacgcgaaaaacgaacgcaccgacctataaaaaaaaaccaaaaaatctacgctaccgacgcccgatcgcacctccgccccgaaccctttccgcgataaatttaaacaaaaaacgctaaaactccgaaaaaaaacgaacccaataaaaaacgcgcaaaaaaacaacttcaaaccaaaaaaatacaaaatcacaaaaatcaaaaaaataaacacaaaaaaacataaactaaaaaaacaaaaaaaaacgacaaaaacttaaaaaaacgaaaaaacacaaaaaaaccctaaacgctaactccaaaaacgaacccaaaaaatataaaatcaaactaacgacgacgtcgtcgactacgaccgaaaccgacgtcgcgcgtccctacatcctcgcatccgtctacaccgacatacgataaactctcaaaaatcgaaacgcgaatacaacgcgccgatcttactatcgtaatcccaataaaaacaatacatcataacgaactcgaactaccgaacacaaacgaactacaaacccgacgcactaataaacgcgaacgccgaaaacgcgacgataactaaactaacaaaactaaactaacccgacgacgacgcgacgaccccgtaatacgataaaacaaacgacgatacgacgaccgcgtacaaataatatacgtacgaatacgaataaaaatacgacgaaaacgaaaatacgaccgacgaacctcccaaaccattatacgaattcactacgccgaaaaacaacgccatactctacacgcgtatatacgacccgtacgaaacgaccgaacccgccaaccccttaaccacaacgaccgcgccaaaactaccgaaacccgcgactacaaccgcaactactacaaccgctacgactaccgccatctaacaaaaaacataaaacataaataaaaaaaactacgataacgaccacgaattattaaaaaaaccaaactacaaatacttaaaaaacgccaaataaccgtaaccgtcgaccccgacgcccgccacgccgcacccgcctacgacgcctccgaccccgaaaaaccccttaccgaactaaaaatacgcgaacgacgaccgaaaaaacctcttcatacgacgacgacgccgataattacccttctcgaacatatcttcgcaaaccgaatccaacgtccaataattacccttacgctcgccgccgccctcgcgcgacaccttaataaaacactcgttaaaactaaaattataacgaatactattttaccaacccttcttattcttctcgtaaaacgaaaacttcgcgataatatactaataaataccgaacaacgtaaacctcttctccgcgctctcgcgaatcgccataacgataaacgccacgtacgaatacgaaaacttctacgccgaatccgacttctccgaaactatcccgccgccacccccaccgcccttacctaaactcgacgacgacccttctaactccttaactatacgaccgatctctaaaaccaacaaaacccccgccgcgtcctcgaactcgaaataactaaccatcataacaaaaccgacgcgccgcgaccgaaccgcctctactctccgctccaaacgctaacgcgacaaaaaattaaaacgcacgaatccgcttacgaccaaatctcaaacttctaaaaactacgaataccgcccgcgcttacttactaaaaacctatcgctactctcccctctccttccccttcccctaaaaaacgaccgacgaaaataaaactcaacctctaaccataaaaaatccgcccaacaaaaaaaaactccgacctcgccgcccctccccgctcaaaccaatccccgccttaataaattttcttttctacgctcttcccctccccccgccccccgatttcccgaaacacgacccgcgtctctaacgaaactacctcctaaaatccctaatacgccaaaaacctcgctctattctaat

SEQ ID NO: 10 - DNA, 2917 bp, Artificial Sequence
  bisulfite converted genomic DNA
attagaatagagcgaggtttttggcgtattagggattttaggaggtagtttcgttagagacgcgggtcgtgtttcgggaaatcggggggcggggggaggggaagagcgtagaaaagaaaatttattaaggcggggattggtttgagcggggaggggcggcgaggtcggagtttttttttgttgggcggattttttatggttagaggttgagttttattttcgtcggtcgttttttaggggaaggggaaggagaggggagagtagcgataggtttttagtaagtaagcgcgggcggtattcgtagtttttagaagtttgagatttggtcgtaagcggattcgtgcgttttaattttttgtcgcgttagcgtttggagcggagagtagaggcggttcggtcgcggcgcgtcggttttgttatgatggttagttatttcgagttcgaggacgcggcgggggttttgttggttttagagatcggtcgtatagttaaggagttagaagggtcgtcgtcgagtttaggtaagggcggtgggggtggcggcgggatagtttcggagaagtcggattcggcgtagaagttttcgtattcgtacgtggcgtttatcgttatggcgattcgcgagagcgcggagaagaggtttacgttgttcggtatttattagtatattatcgcgaagttttcgttttacgagaagaataagaagggttggtaaaatagtattcgttataattttagttttaacgagtgttttattaaggtgtcgcgcgagggcggcggcgagcgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcggttgtagtcgcgggtttcggtagttttggcgcggtcgttgtggttaaggggttggcgggttcggtcgtttcgtacgggtcgtatatacgcgtgtagagtatggcgttgtttttcggcgtagtgaattcgtataatggtttgggaggttcgtcggtcgtattttcgttttcgtcgtatttttattcgtattcgtacgtatattatttgtacgcggtcgtcgtatcgtcgtttgttttatcgtattacggggtcgtcgcgtcgtcgtcgggttagtttagttttgttagtttagttatcgtcgcgttttcggcgttcgcgtttattagtgcgtcgggtttgtagttcgtttgtgttcggtagttcgagttcgttatgatgtattgtttttattgggattacgatagtaagatcggcgcgttgtattcgcgtttcgatttttgagagtttatcgtatgtcggtgtagacggatgcgaggatgtagggacgcgcgacgtcggtttcggtcgtagtcgacgacgtcgtcgttagtttgattttatattttttgggttcgtttttggagttagcgtttagggtttttttgtgttttttcgtttttttaagtttttgtcgtttttttttgtttttttagtttatgtttttttgtgtttatttttttgatttttgtgattttgtatttttttggtttgaagttgtttttttgcgcgttttttattgggttcgttttttttcggagttttagcgttttttgtttaaatttatcgcggaaagggttcggggcggaggtgcgatcgggcgtcggtagcgtagattttttggtttttttttataggtcggtgcgttcgtttttcgcgtttttcgttcgattgtcgtgtagtttatggttagacgcgtcggataggattgatggcgggatcgcgttgttcgagaaagggacggattaatacgtgtgtttgtttcgcgaatttttttgaagttgtttagaagtcgtttgtcgcggggtttattaggcggggcgggggttgggatttagcgggagtcggggtagtttggttttacggtttgtattcggtttatatcgcgggcgggcgcggagggaggttgcgtttttttcgttattagtttcgtcgtttcgggtattttcgggtttcggcggttggttaatgttttgtttgaaagatcggtggaattttttaagagagtatttaaaaaaaaaaaaaggaaaaaaaatttatcgggtaatcggggaagtattgtggttttggagtttgttaaatttaaatatgaaaattaaaagttttagtattttttatttttttttttggaagatttgcgttagagtttttgttgggtttttaaaaagttgtgtttagagttaggagaatatatttaataaaagatggtttcgtttattaattggggaagttttattttttttttatttgaagaaaaaaattaaaaataaatgttttcggatttttcgatgtaagttttggaggtagggagattattgtttgtttggtttacgttgttgggacggttcgttttttttgttttttgttttttaaattttttgttttttttattttgggaaggagaaatgtgaaattcggtagcggtcgatttaggcggttttgtggttcggagtcggttcggttcgaaaattatagatttggttgtattgtagtttgttgtttgggggattaaattttttagagagaattagagtatttttgttgtgtttttttgttttgtttttgttttttgttttgtcgattttcgaataaattttgtgtttttttttttaa

SEQ ID NO: 11 - DNA, 1616 bp, Homo sapiens
cccctggccttgtagcccctgttccggggatcagctgggcccacctaacccccctacatggggttgaaaggggccaatgggacggccccgccgcccctccctcgggattccacagggccctgacccggcctttatctctgcacggtcagcagtcgcgggggcttcaggaaggaggacaaaggcccggtgtcaccgcgggcgggggctcggtttcctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaaccgggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaaacgtgtgaagaccgctttgggggaagcgagagggaggttggaggagccccgggcggggtctcagcgcccaccagctgtgccttcagggcttgggtgttcgctgcaacggcaaccgcgtgagcctcactcccacggccaaggggctagggcagggtggatgcaatcgcgtgcgcctggccccggaaggtgctcgcagggggtgcctgtggccagctgggttaggaagtcaaatcctagaaagttattactaaaggttttttttcccccttcctttcttctttccttttttgcttccttccttccttttttttttttaataggggaagggaaaaaacattattgaacatctactataaactgggcacttaaaaattagaaaatttaattattttaataattctgatacacgcacgtatttctgttttatagaggagaacactgaaatttgaatgggtattttgcccaaggttacatagctgttaaagaggacaccaggctcc

SEQ ID NO: 12 - DNA, 1616 bp, Artificial Sequence
  bisulfite converted genomic DNA
tttttggttttgtagtttttgtttcggggattagttgggtttatttaatttttttatatggggttgaaaggggttaatgggacggtttcgtcgtttttttttcgggattttatagggttttgattcggtttttatttttgtacggttagtagtcgcgggggttttaggaaggaggataaaggttcggtgttatcgcgggcgggggttcggttttttggttttttgtttatatttatagtttttagcggttgttgggggaagatttttaaaaatatgtgtcgaatttttttttttttttttttagaaataaataaataaaaaaggtaaaaggcgaatttttttttatttttcgtttatagagattaaagttttttgggattttgttttttttttttttttgattgtttagaaatatttgtttttttttgtatatagaggaaaatgcggggaaaggttttttaaaattcggttttatattattattattattaaggataatcgggtaggttgaggttttaacgtggatgattcgagttggtttcgcgtcggggttttgtagttattgttttgtgcgtttagtatttttgggggcgattagggtttttgcgttttcgttcgtcgttcggtagtcgagagtattttgtgtttagattggtcgatttattttttttcgaattttgtttagagttggtaagggggatttagttcgcgttttaagatttgggtttgtagcgtcgttaataggttcggggatacgaggcgttttaggtcggggttttttcggttgttggtttttttcgttttttattcgttggcggcgtttcggtcgttcgtaattgatttaattcgttttttgcgtttgttttttaggtttttcgtttttttataaaggtttaggggagtttcgtttataggttgattttgtaatttttggttcggtggttattttttgtttttttgaaaaagaaaaggaaaaaaaaaaaaaaaaagaaaaaattaattagtcgagggaggcgcgtgaggattggaggcgttagtcggatagtttatgagtaggtttttgggtcggtgtcgtttcgcgggttagtacggttttttttagagaaaattttttaaacgtgtgaagatcgttttgggggaagcgagagggaggttggaggagtttcgggcggggttttagcgtttattagttgtgtttttagggtttgggtgttcgttgtaacggtaatcgcgtgagttttatttttacggttaaggggttagggtagggtggatgtaatcgcgtgcgtttggtttcggaaggtgttcgtagggggtgtttgtggttagttgggttaggaagttaaattttagaaagttattattaaaggtttttttttttttttttttttttttttttttttttgtttttttttttttttttttttttttaataggggaagggaaaaaatattattgaatatttattataaattgggtatttaaaaattagaaaatttaattattttaataattttgatatacgtacgtatttttgttttatagaggagaatattgaaatttgaatgggtattttgtttaaggttatatagttgttaaagaggatattaggtttt

SEQ ID NO: 13 - DNA, 1616 bp, Artificial Sequence
  bisulfite converted genomic DNA
aaaacctaatatcctctttaacaactatataaccttaaacaaaatacccattcaaatttcaatattctcctctataaaacaaaaatacgtacgtatatcaaaattattaaaataattaaattttctaatttttaaatacccaatttataataaatattcaataatattttttcccttcccctattaaaaaaaaaaaaaaaaaaaaaaaaacaaaaaaaaaaaaaaaaaaaaaaaaaaaaaaaaaaacctttaataataactttctaaaatttaacttcctaacccaactaaccacaaacaccccctacgaacaccttccgaaaccaaacgcacgcgattacatccaccctaccctaaccccttaaccgtaaaaataaaactcacgcgattaccgttacaacgaacacccaaaccctaaaaacacaactaataaacgctaaaaccccgcccgaaactcctccaacctccctctcgcttcccccaaaacgatcttcacacgtttaaaaaattttctctaaaaaaaaccgtactaacccgcgaaacgacaccgacccaaaaacctactcataaactatccgactaacgcctccaatcctcacgcgcctccctcgactaattaattttttctttttttttttttttttccttttctttttcaaaaaaacaaaaaataaccaccgaaccaaaaattacaaaatcaacctataaacgaaactcccctaaacctttataaaaaaacgaaaaacctaaaaaacaaacgcaaaaaacgaattaaatcaattacgaacgaccgaaacgccgccaacgaataaaaaacgaaaaaaaccaacaaccgaaaaaaccccgacctaaaacgcctcgtatccccgaacctattaacgacgctacaaacccaaatcttaaaacgcgaactaaatcccccttaccaactctaaacaaaattcgaaaaaaaataaatcgaccaatctaaacacaaaatactctcgactaccgaacgacgaacgaaaacgcaaaaaccctaatcgcccccaaaaatactaaacgcacaaaacaataactacaaaaccccgacgcgaaaccaactcgaatcatccacgttaaaacctcaacctacccgattatccttaataataataataatataaaaccgaattttaaaaaacctttccccgcattttcctctatatacaaaaaaaaacaaatatttctaaacaatcaaaaaaaaaaaaaaaacaaaatcccaaaaaactttaatctctataaacgaaaaataaaaaaaaattcgccttttaccttttttatttatttatttctaaaaaaaaaaaaaaaaaaattcgacacatatttttaaaaatcttcccccaacaaccgctaaaaactataaatataaacaaaaaaccaaaaaaccgaacccccgcccgcgataacaccgaacctttatcctccttcctaaaacccccgcgactactaaccgtacaaaaataaaaaccgaatcaaaaccctataaaatcccgaaaaaaaaacgacgaaaccgtcccattaacccctttcaaccccatataaaaaaattaaataaacccaactaatccccgaaacaaaaactacaaaaccaaaaa

SEQ ID NO: 14 - DNA, 1616 bp, Artificial Sequence
  bisulfite converted genomic DNA
cccctaaccttataacccctattccgaaaatcaactaaacccacctaacccccctacataaaattaaaaaaaaccaataaaacgaccccgccgcccctccctcgaaattccacaaaaccctaacccgacctttatctctacacgatcaacaatcgcgaaaacttcaaaaaaaaaaacaaaaacccgatatcaccgcgaacgaaaactcgatttcctaactctctactcacactcacaacctttaacgattattaaaaaaaaatttttaaaaatatatatcgaatttcctttttttctcttctaaaaacaaacaaacaaaaaaaacaaaaaacgaattccccttcactcctcgtccataaaaattaaaatttcctaaaatcctaccctttttttttctttaactacctaaaaatacttattctcccttatacataaaaaaaaatacgaaaaaaaattttttaaaactcgatttcatactattattattactaaaaacaaccgaacaaactaaaatcccaacgtaaataatccgaattaacctcgcgccgaaactctacaaccactaccctatacgctcaacacctctaaaaacgatcaaaacccctacgcttccgcccgccgcccgacaatcgaaaacaccctatacccaaactaaccgactcattctcccccgaattttatttaaaactaacaaaaaaaacttaactcgcgccccaaaacctaaacttacaacgccgccaacaaacccgaaaacacgaaacgctccaaaccgaaatcttcccgactactaacccctctcgctccccacccgctaacgacgcctcgatcgcccgcaattaacccaacccgcttcctacgtttacccctcaaatttcccgtttctccacaaaaacctaaaaaaacctcgcccacaaactaaccctacaacctctaacccgataactaccttctacttttctaaaaaaaaaaaaaaaaaaaaaaaaaaaaaaaaaaaaatcaaccaatcgaaaaaaacgcgtaaaaactaaaaacgccaaccgaacaacctataaataaatccctaaatcgataccgcttcgcgaatcaacacgacctttctcaaaaaaaacctcctaaacgtataaaaaccgctttaaaaaaaacgaaaaaaaaattaaaaaaaccccgaacgaaatctcaacgcccaccaactataccttcaaaacttaaatattcgctacaacgacaaccgcgtaaacctcactcccacgaccaaaaaactaaaacaaaataaatacaatcgcgtacgcctaaccccgaaaaatactcgcaaaaaatacctataaccaactaaattaaaaaatcaaatcctaaaaaattattactaaaaattttttttcccccttcctttcttctttccttttttacttccttccttccttttttttttttaataaaaaaaaaaaaaaaacattattaaacatctactataaactaaacacttaaaaattaaaaaatttaattattttaataattctaatacacgcacgtatttctattttataaaaaaaaacactaaaatttaaataaatattttacccaaaattacataactattaaaaaaaacaccaaactcc

SEQ ID NO: 15 - DNA, 1616 bp, Artificial Sequence
  bisulfite converted genomic DNA
ggagtttggtgttttttttaatagttatgtaattttgggtaaaatatttatttaaattttagtgtttttttttataaaatagaaatacgtgcgtgtattagaattattaaaataattaaattttttaatttttaagtgtttagtttatagtagatgtttaataatgttttttttttttttttattaaaaaaaaaaaaggaaggaaggaagtaaaaaaggaaagaagaaaggaagggggaaaaaaaatttttagtaataattttttaggatttgattttttaatttagttggttataggtattttttgcgagtatttttcggggttaggcgtacgcgattgtatttattttgttttagttttttggtcgtgggagtgaggtttacgcggttgtcgttgtagcgaatatttaagttttgaaggtatagttggtgggcgttgagatttcgttcggggtttttttaatttttttttcgttttttttaaagcggtttttatacgtttaggaggttttttttgagaaaggtcgtgttgattcgcgaagcggtatcgatttagggatttatttataggttgttcggttggcgtttttagtttttacgcgtttttttcgattggttgatttttttttttttttttttttttttttttttttttttagaaaagtagaaggtagttatcgggttagaggttgtagggttagtttgtgggcgaggtttttttaggtttttgtggagaaacgggaaatttgaggggtaaacgtaggaagcgggttgggttaattgcgggcgatcgaggcgtcgttagcgggtggggagcgagaggggttagtagtcgggaagatttcggtttggagcgtttcgtgttttcgggtttgttggcggcgttgtaagtttaggttttggggcgcgagttaagttttttttgttagttttaaataaaattcgggggagaatgagtcggttagtttgggtatagggtgttttcgattgtcgggcggcgggcggaagcgtaggggttttgatcgtttttagaggtgttgagcgtatagggtagtggttgtagagtttcggcgcgaggttaattcggattatttacgttgggattttagtttgttcggttgtttttagtaataataatagtatgaaatcgagttttaaaaaattttttttcgtatttttttttatgtataagggagaataagtatttttaggtagttaaagaaaaaaaaagggtaggattttaggaaattttaatttttatggacgaggagtgaaggggaattcgttttttgttttttttgtttgtttgtttttagaagagaaaaaaaggaaattcgatatatatttttaaaaatttttttttaataatcgttaaaggttgtgagtgtgagtagagagttaggaaatcgagttttcgttcgcggtgatatcgggtttttgtttttttttttgaagttttcgcgattgttgatcgtgtagagataaaggtcgggttagggttttgtggaatttcgagggaggggcggcggggtcgttttattggttttttttaattttatgtaggggggttaggtgggtttagttgattttcggaataggggttataaggttagggg

SEQ ID NO: 16 - DNA, 1072 bp, Homo sapiens
gccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaaacgtgtgaagaccgctttgggggaagcgagagggaggttggaggagccccgggcggggtctcagcgcccaccagctgtgccttcagggcttgggtgttcgctgcaacggcaaccgcgtgagcctcactcccacggccaaggggctagggcagggtggatgcaatcgcgtgcgcctggccccggaaggtgctcgcagggggtgcctgtggccagctgggttaggaagtcaaatcctagaaagttattactaaaggttttttttcccccttcctttcttctttccttttttgcttccttccttccttttttttttttaataggggaagggaaaaaacattattgaacatctactataaactgggcacttaaaaattagaaaatttaattattttaataattctgatacacgcacgtatttctgttttatagaggagaacactgaaatttgaatgggtattttgcccaaggttacatagctgttaaagaggacaccaggctcc

SEQ ID NO: 17 - DNA, 1072 bp, Artificial Sequence
  bisulfite converted genomic DNA
gtcggggttttgtagttattgttttgtgcgtttagtatttttgggggcgattagggtttttgcgttttcgttcgtcgttcggtagtcgagagtattttgtgtttagattggtcgatttattttttttcgaattttgtttagagttggtaagggggatttagttcgcgttttaagatttgggtttgtagcgtcgttaataggttcggggatacgaggcgttttaggtcggggttttttcggttgttggtttttttcgttttttattcgttggcggcgtttcggtcgttcgtaattgatttaattcgttttttgcgtttgttttttaggtttttcgtttttttataaaggtttaggggagtttcgtttataggttgattttgtaatttttggttcggtggttattttttgtttttttgaaaaagaaaaggaaaaaaaaaaaaaaaaagaaaaaattaattagtcgagggaggcgcgtgaggattggaggcgttagtcggatagtttatgagtaggtttttgggtcggtgtcgtttcgcgggttagtacggttttttttagagaaaattttttaaacgtgtgaagatcgttttgggggaagcgagagggaggttggaggagtttcgggcggggttttagcgtttattagttgtgtttttagggtttgggtgttcgttgtaacggtaatcgcgtgagttttatttttacggttaaggggttagggtagggtggatgtaatcgcgtgcgtttggtttcggaaggtgttcgtagggggtgtttgtggttagttgggttaggaagttaaattttagaaagttattattaaaggtttttttttttttttttttttttttttttttttttgtttttttttttttttttttttttttaataggggaagggaaaaaatattattgaatatttattataaattgggtatttaaaaattagaaaatttaattattttaataattttgatatacgtacgtatttttgttttatagaggagaatattgaaatttgaatgggtattttgtttaaggttatatagttgttaaagaggatattaggtttt

SEQ ID NO: 18 - DNA, 1072 bp, Artificial Sequence
  bisulfite converted genomic DNA
aaaacctaatatcctctttaacaactatataaccttaaacaaaatacccattcaaatttcaatattctcctctataaaacaaaaatacgtacgtatatcaaaattattaaaataattaaattttctaatttttaaatacccaatttataataaatattcaataatattttttcccttcccctattaaaaaaaaaaaaaaaaaaaaaaaaacaaaaaaaaaaaaaaaaaaaaaaaaaaaaaaaaaaacctttaataataactttctaaaatttaacttcctaacccaactaaccacaaacaccccctacgaacaccttccgaaaccaaacgcacgcgattacatccaccctaccctaaccccttaaccgtaaaaataaaactcacgcgattaccgttacaacgaacacccaaaccctaaaaacacaactaataaacgctaaaaccccgcccgaaactcctccaacctccctctcgcttcccccaaaacgatcttcacacgtttaaaaaattttctctaaaaaaaaccgtactaacccgcgaaacgacaccgacccaaaaacctactcataaactatccgactaacgcctccaatcctcacgcgcctccctcgactaattaattttttctttttttttttttttttccttttctttttcaaaaaaacaaaaaataaccaccgaaccaaaaattacaaaatcaacctataaacgaaactcccctaaacctttataaaaaaacgaaaaacctaaaaaacaaacgcaaaaaacgaattaaatcaattacgaacgaccgaaacgccgccaacgaataaaaaacgaaaaaaaccaacaaccgaaaaaaccccgacctaaaacgcctcgtatccccgaacctattaacgacgctacaaacccaaatcttaaaacgcgaactaaatcccccttaccaactctaaacaaaattcgaaaaaaaataaatcgaccaatctaaacacaaaatactctcgactaccgaacgacgaacgaaaacgcaaaaaccctaatcgcccccaaaaatactaaacgcacaaaacaataactacaaaaccccgac

SEQ ID NO: 19 - DNA, 1072 bp, Artificial Sequence
  bisulfite converted genomic DNA
accgaaactctacaaccactaccctatacgctcaacacctctaaaaacgatcaaaacccctacgcttccgcccgccgcccgacaatcgaaaacaccctatacccaaactaaccgactcattctcccccgaattttatttaaaactaacaaaaaaaacttaactcgcgccccaaaacctaaacttacaacgccgccaacaaacccgaaaacacgaaacgctccaaaccgaaatcttcccgactactaacccctctcgctccccacccgctaacgacgcctcgatcgcccgcaattaacccaacccgcttcctacgtttacccctcaaatttcccgtttctccacaaaaacctaaaaaaacctcgcccacaaactaaccctacaacctctaacccgataactaccttctacttttctaaaaaaaaaaaaaaaaaaaaaaaaaaaaaaaaaaaaatcaaccaatcgaaaaaaacgcgtaaaaactaaaaacgccaaccgaacaacctataaataaatccctaaatcgataccgcttcgcgaatcaacacgacctttctcaaaaaaaacctcctaaacgtataaaaaccgctttaaaaaaaacgaaaaaaaaattaaaaaaaccccgaacgaaatctcaacgcccaccaactataccttcaaaacttaaatattcgctacaacgacaaccgcgtaaacctcactcccacgaccaaaaaactaaaacaaaataaatacaatcgcgtacgcctaaccccgaaaaatactcgcaaaaaatacctataaccaactaaattaaaaaatcaaatcctaaaaaattattactaaaaattttttttcccccttcctttcttctttccttttttacttccttccttccttttttttttttaataaaaaaaaaaaaaaaacattattaaacatctactataaactaaacacttaaaaattaaaaaatttaattattttaataattctaatacacgcacgtatttctattttataaaaaaaaacactaaaatttaaataaatattttacccaaaattacataactattaaaaaaaacaccaaactcc

SEQ ID NO: 20 - DNA, 1072 bp, Artificial Sequence
  bisulfite converted genomic DNA
ggagtttggtgttttttttaatagttatgtaattttgggtaaaatatttatttaaattttagtgtttttttttataaaatagaaatacgtgcgtgtattagaattattaaaataattaaattttttaatttttaagtgtttagtttatagtagatgtttaataatgttttttttttttttttattaaaaaaaaaaaaggaaggaaggaagtaaaaaaggaaagaagaaaggaagggggaaaaaaaatttttagtaataattttttaggatttgattttttaatttagttggttataggtattttttgcgagtatttttcggggttaggcgtacgcgattgtatttattttgttttagttttttggtcgtgggagtgaggtttacgcggttgtcgttgtagcgaatatttaagttttgaaggtatagttggtgggcgttgagatttcgttcggggtttttttaatttttttttcgttttttttaaagcggtttttatacgtttaggaggttttttttgagaaaggtcgtgttgattcgcgaagcggtatcgatttagggatttatttataggttgttcggttggcgtttttagtttttacgcgtttttttcgattggttgatttttttttttttttttttttttttttttttttttttagaaaagtagaaggtagttatcgggttagaggttgtagggttagtttgtgggcgaggtttttttaggtttttgtggagaaacgggaaatttgaggggtaaacgtaggaagcgggttgggttaattgcgggcgatcgaggcgtcgttagcgggtggggagcgagaggggttagtagtcgggaagatttcggtttggagcgtttcgtgttttcgggtttgttggcggcgttgtaagtttaggttttggggcgcgagttaagttttttttgttagttttaaataaaattcgggggagaatgagtcggttagtttgggtatagggtgttttcgattgtcgggcggcgggcggaagcgtaggggttttgatcgtttttagaggtgttgagcgtatagggtagtggttgtagagtttcggt

SEQ ID NO: 21 - DNA, 1071 bp, Homo sapiens
cccctggccttgtagcccctgttccggggatcagctgggcccacctaacccccctacatggggttgaaaggggccaatgggacggccccgccgcccctccctcgggattccacagggccctgacccggcctttatctctgcacggtcagcagtcgcgggggcttcaggaaggaggacaaaggcccggtgtcaccgcgggcgggggctcggtttcctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaaccgggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtg

SEQ ID NO: 22 - DNA, 1071 bp, Artificial Sequence
  bisulfite converted genomic DNA
tttttggttttgtagtttttgtttcggggattagttgggtttatttaatttttttatatggggttgaaaggggttaatgggacggtttcgtcgtttttttttcgggattttatagggttttgattcggtttttatttttgtacggttagtagtcgcgggggttttaggaaggaggataaaggttcggtgttatcgcgggcgggggttcggttttttggttttttgtttatatttatagtttttagcggttgttgggggaagatttttaaaaatatgtgtcgaatttttttttttttttttttagaaataaataaataaaaaaggtaaaaggcgaatttttttttatttttcgtttatagagattaaagttttttgggattttgttttttttttttttttgattgtttagaaatatttgtttttttttgtatatagaggaaaatgcggggaaaggttttttaaaattcggttttatattattattattattaaggataatcgggtaggttgaggttttaacgtggatgattcgagttggtttcgcgtcggggttttgtagttattgttttgtgcgtttagtatttttgggggcgattagggtttttgcgttttcgttcgtcgttcggtagtcgagagtattttgtgtttagattggtcgatttattttttttcgaattttgtttagagttggtaagggggatttagttcgcgttttaagatttgggtttgtagcgtcgttaataggttcggggatacgaggcgttttaggtcggggttttttcggttgttggtttttttcgttttttattcgttggcggcgtttcggtcgttcgtaattgatttaattcgttttttgcgtttgttttttaggtttttcgtttttttataaaggtttaggggagtttcgtttataggttgattttgtaatttttggttcggtggttattttttgtttttttgaaaaagaaaaggaaaaaaaaaaaaaaaaagaaaaaattaattagtcgagggaggcgcgtgaggattggaggcgttagtcggatagtttatgagtaggtttttgggtcggtg

SEQ ID NO: 23 - DNA, 1071 bp, Artificial Sequence
  bisulfite converted genomic DNA
caccgacccaaaaacctactcataaactatccgactaacgcctccaatcctcacgcgcctccctcgactaattaattttttctttttttttttttttttccttttctttttcaaaaaaacaaaaaataaccaccgaaccaaaaattacaaaatcaacctataaacgaaactcccctaaacctttataaaaaaacgaaaaacctaaaaaacaaacgcaaaaaacgaattaaatcaattacgaacgaccgaaacgccgccaacgaataaaaaacgaaaaaaaccaacaaccgaaaaaaccccgacctaaaacgcctcgtatccccgaacctattaacgacgctacaaacccaaatcttaaaacgcgaactaaatcccccttaccaactctaaacaaaattcgaaaaaaaataaatcgaccaatctaaacacaaaatactctcgactaccgaacgacgaacgaaaacgcaaaaaccctaatcgcccccaaaaatactaaacgcacaaaacaataactacaaaaccccgacgcgaaaccaactcgaatcatccacgttaaaacctcaacctacccgattatccttaataataataataatataaaaccgaattttaaaaaacctttccccgcattttcctctatatacaaaaaaaaacaaatatttctaaacaatcaaaaaaaaaaaaaaaacaaaatcccaaaaaactttaatctctataaacgaaaaataaaaaaaaattcgccttttaccttttttatttatttatttctaaaaaaaaaaaaaaaaaaattcgacacatatttttaaaaatcttcccccaacaaccgctaaaaactataaatataaacaaaaaaccaaaaaaccgaacccccgcccgcgataacaccgaacctttatcctccttcctaaaacccccgcgactactaaccgtacaaaaataaaaaccgaatcaaaaccctataaaatcccgaaaaaaaaacgacgaaaccgtcccattaacccctttcaaccccatataaaaaaattaaataaacccaactaatccccgaaacaaaaactacaaaaccaaaaa

SEQ ID NO: 24 - DNA, 1071 bp, Artificial Sequence
  bisulfite converted genomic DNA
cccctaaccttataacccctattccgaaaatcaactaaacccacctaacccccctacataaaattaaaaaaaaccaataaaacgaccccgccgcccctccctcgaaattccacaaaaccctaacccgacctttatctctacacgatcaacaatcgcgaaaacttcaaaaaaaaaaacaaaaacccgatatcaccgcgaacgaaaactcgatttcctaactctctactcacactcacaacctttaacgattattaaaaaaaaatttttaaaaatatatatcgaatttcctttttttctcttctaaaaacaaacaaacaaaaaaaacaaaaaacgaattccccttcactcctcgtccataaaaattaaaatttcctaaaatcctaccctttttttttctttaactacctaaaaatacttattctcccttatacataaaaaaaaatacgaaaaaaaattttttaaaactcgatttcatactattattattactaaaaacaaccgaacaaactaaaatcccaacgtaaataatccgaattaacctcgcgccgaaactctacaaccactaccctatacgctcaacacctctaaaaacgatcaaaacccctacgcttccgcccgccgcccgacaatcgaaaacaccctatacccaaactaaccgactcattctcccccgaattttatttaaaactaacaaaaaaaacttaactcgcgccccaaaacctaaacttacaacgccgccaacaaacccgaaaacacgaaacgctccaaaccgaaatcttcccgactactaacccctctcgctccccacccgctaacgacgcctcgatcgcccgcaattaacccaacccgcttcctacgtttacccctcaaatttcccgtttctccacaaaaacctaaaaaaacctcgcccacaaactaaccctacaacctctaacccgataactaccttctacttttctaaaaaaaaaaaaaaaaaaaaaaaaaaaaaaaaaaaaatcaaccaatcgaaaaaaacgcgtaaaaactaaaaacgccaaccgaacaacctataaataaatccctaaatcgata

SEQ ID NO: 25 - DNA, 1071 bp, Artificial Sequence
  bisulfite converted genomic DNA
tatcgatttagggatttatttataggttgttcggttggcgtttttagtttttacgcgtttttttcgattggttgatttttttttttttttttttttttttttttttttttttagaaaagtagaaggtagttatcgggttagaggttgtagggttagtttgtgggcgaggtttttttaggtttttgtggagaaacgggaaatttgaggggtaaacgtaggaagcgggttgggttaattgcgggcgatcgaggcgtcgttagcgggtggggagcgagaggggttagtagtcgggaagatttcggtttggagcgtttcgtgttttcgggtttgttggcggcgttgtaagtttaggttttggggcgcgagttaagttttttttgttagttttaaataaaattcgggggagaatgagtcggttagtttgggtatagggtgttttcgattgtcgggcggcgggcggaagcgtaggggttttgatcgtttttagaggtgttgagcgtatagggtagtggttgtagagtttcggcgcgaggttaattcggattatttacgttgggattttagtttgttcggttgtttttagtaataataatagtatgaaatcgagttttaaaaaattttttttcgtatttttttttatgtataagggagaataagtatttttaggtagttaaagaaaaaaaaagggtaggattttaggaaattttaatttttatggacgaggagtgaaggggaattcgttttttgttttttttgtttgtttgtttttagaagagaaaaaaaggaaattcgatatatatttttaaaaatttttttttaataatcgttaaaggttgtgagtgtgagtagagagttaggaaatcgagttttcgttcgcggtgatatcgggtttttgtttttttttttgaagttttcgcgattgttgatcgtgtagagataaaggtcgggttagggttttgtggaatttcgagggaggggcggcggggtcgttttattggttttttttaattttatgtaggggggttaggtgggtttagttgattttcggaataggggttataaggttagggg

SEQ ID NO: 26 - DNA, 1068 bp, Homo sapiens
cctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaaccgggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaaacgtgtgaagaccgctttgggggaagcgagagggaggttggaggagccccgggcggggtctcagcgcccaccagctgtgccttcagggcttgggtgttcgctgcaacggcaaccgcgtgagcctcactcccacggccaaggggctagggcagggtggatgcaatc

SEQ ID NO: 27 - DNA, 1068 bp, Artificial Sequence
  bisulfite converted genomic DNA
tttggttttttgtttatatttatagtttttagcggttgttgggggaagatttttaaaaatatgtgtcgaatttttttttttttttttttagaaataaataaataaaaaaggtaaaaggcgaatttttttttatttttcgtttatagagattaaagttttttgggattttgttttttttttttttttgattgtttagaaatatttgtttttttttgtatatagaggaaaatgcggggaaaggttttttaaaattcggttttatattattattattattaaggataatcgggtaggttgaggttttaacgtggatgattcgagttggtttcgcgtcggggttttgtagttattgttttgtgcgtttagtatttttgggggcgattagggtttttgcgttttcgttcgtcgttcggtagtcgagagtattttgtgtttagattggtcgatttattttttttcgaattttgtttagagttggtaagggggatttagttcgcgttttaagatttgggtttgtagcgtcgttaataggttcggggatacgaggcgttttaggtcggggttttttcggttgttggtttttttcgttttttattcgttggcggcgtttcggtcgttcgtaattgatttaattcgttttttgcgtttgttttttaggtttttcgtttttttataaaggtttaggggagtttcgtttataggttgattttgtaatttttggttcggtggttattttttgtttttttgaaaaagaaaaggaaaaaaaaaaaaaaaaagaaaaaattaattagtcgagggaggcgcgtgaggattggaggcgttagtcggatagtttatgagtaggtttttgggtcggtgtcgtttcgcgggttagtacggttttttttagagaaaattttttaaacgtgtgaagatcgttttgggggaagcgagagggaggttggaggagtttcgggcggggttttagcgtttattagttgtgtttttagggtttgggtgttcgttgtaacggtaatcgcgtgagttttatttttacggttaaggggttagggtagggtggatgtaatt

SEQ ID NO: 28 - DNA, 1068 bp, Artificial Sequence
  bisulfite converted genomic DNA
aattacatccaccctaccctaaccccttaaccgtaaaaataaaactcacgcgattaccgttacaacgaacacccaaaccctaaaaacacaactaataaacgctaaaaccccgcccgaaactcctccaacctccctctcgcttcccccaaaacgatcttcacacgtttaaaaaattttctctaaaaaaaaccgtactaacccgcgaaacgacaccgacccaaaaacctactcataaactatccgactaacgcctccaatcctcacgcgcctccctcgactaattaattttttctttttttttttttttttccttttctttttcaaaaaaacaaaaaataaccaccgaaccaaaaattacaaaatcaacctataaacgaaactcccctaaacctttataaaaaaacgaaaaacctaaaaaacaaacgcaaaaaacgaattaaatcaattacgaacgaccgaaacgccgccaacgaataaaaaacgaaaaaaaccaacaaccgaaaaaaccccgacctaaaacgcctcgtatccccgaacctattaacgacgctacaaacccaaatcttaaaacgcgaactaaatcccccttaccaactctaaacaaaattcgaaaaaaaataaatcgaccaatctaaacacaaaatactctcgactaccgaacgacgaacgaaaacgcaaaaaccctaatcgcccccaaaaatactaaacgcacaaaacaataactacaaaaccccgacgcgaaaccaactcgaatcatccacgttaaaacctcaacctacccgattatccttaataataataataatataaaaccgaattttaaaaaacctttccccgcattttcctctatatacaaaaaaaaacaaatatttctaaacaatcaaaaaaaaaaaaaaaacaaaatcccaaaaaactttaatctctataaacgaaaaataaaaaaaaattcgccttttaccttttttatttatttatttctaaaaaaaaaaaaaaaaaaattcgacacatatttttaaaaatcttcccccaacaaccgctaaaaactataaatataaacaaaaaaccaaa

SEQ ID NO: 29 - DNA, 1068 bp, Artificial Sequence
  bisulfite converted genomic DNA
cctaactctctactcacactcacaacctttaacgattattaaaaaaaaatttttaaaaatatatatcgaatttcctttttttctcttctaaaaacaaacaaacaaaaaaaacaaaaaacgaattccccttcactcctcgtccataaaaattaaaatttcctaaaatcctaccctttttttttctttaactacctaaaaatacttattctcccttatacataaaaaaaaatacgaaaaaaaattttttaaaactcgatttcatactattattattactaaaaacaaccgaacaaactaaaatcccaacgtaaataatccgaattaacctcgcgccgaaactctacaaccactaccctatacgctcaacacctctaaaaacgatcaaaacccctacgcttccgcccgccgcccgacaatcgaaaacaccctatacccaaactaaccgactcattctcccccgaattttatttaaaactaacaaaaaaaacttaactcgcgccccaaaacctaaacttacaacgccgccaacaaacccgaaaacacgaaacgctccaaaccgaaatcttcccgactactaacccctctcgctccccacccgctaacgacgcctcgatcgcccgcaattaacccaacccgcttcctacgtttacccctcaaatttcccgtttctccacaaaaacctaaaaaaacctcgcccacaaactaaccctacaacctctaacccgataactaccttctacttttctaaaaaaaaaaaaaaaaaaaaaaaaaaaaaaaaaaaaatcaaccaatcgaaaaaaacgcgtaaaaactaaaaacgccaaccgaacaacctataaataaatccctaaatcgataccgcttcgcgaatcaacacgacctttctcaaaaaaaacctcctaaacgtataaaaaccgctttaaaaaaaacgaaaaaaaaattaaaaaaaccccgaacgaaatctcaacgcccaccaactataccttcaaaacttaaatattcgctacaacgacaaccgcgtaaacctcactcccacgaccaaaaaactaaaacaaaataaatacaatc

SEQ ID NO: 30 - DNA, 1068 bp, Artificial Sequence
  bisulfite converted genomic DNA
gattgtatttattttgttttagttttttggtcgtgggagtgaggtttacgcggttgtcgttgtagcgaatatttaagttttgaaggtatagttggtgggcgttgagatttcgttcggggtttttttaatttttttttcgttttttttaaagcggtttttatacgtttaggaggttttttttgagaaaggtcgtgttgattcgcgaagcggtatcgatttagggatttatttataggttgttcggttggcgtttttagtttttacgcgtttttttcgattggttgatttttttttttttttttttttttttttttttttttttagaaaagtagaaggtagttatcgggttagaggttgtagggttagtttgtgggcgaggtttttttaggtttttgtggagaaacgggaaatttgaggggtaaacgtaggaagcgggttgggttaattgcgggcgatcgaggcgtcgttagcgggtggggagcgagaggggttagtagtcgggaagatttcggtttggagcgtttcgtgttttcgggtttgttggcggcgttgtaagtttaggttttggggcgcgagttaagttttttttgttagttttaaataaaattcgggggagaatgagtcggttagtttgggtatagggtgttttcgattgtcgggcggcgggcggaagcgtaggggttttgatcgtttttagaggtgttgagcgtatagggtagtggttgtagagtttcggcgcgaggttaattcggattatttacgttgggattttagtttgttcggttgtttttagtaataataatagtatgaaatcgagttttaaaaaattttttttcgtatttttttttatgtataagggagaataagtatttttaggtagttaaagaaaaaaaaagggtaggattttaggaaattttaatttttatggacgaggagtgaaggggaattcgttttttgttttttttgtttgtttgtttttagaagagaaaaaaaggaaattcgatatatatttttaaaaatttttttttaataatcgttaaaggttgtgagtgtgagtagagagttagg

SEQ ID NO: 31 - DNA, 616 bp, Homo sapiens
gggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaa

SEQ ID NO: 32 - DNA, 616 bp, Artificial Sequence
  bisulfite converted genomic DNA
gggtaggttgaggttttaacgtggatgattcgagttggtttcgcgtcggggttttgtagttattgttttgtgcgtttagtatttttgggggcgattagggtttttgcgttttcgttcgtcgttcggtagtcgagagtattttgtgtttagattggtcgatttattttttttcgaattttgtttagagttggtaagggggatttagttcgcgttttaagatttgggtttgtagcgtcgttaataggttcggggatacgaggcgttttaggtcggggttttttcggttgttggtttttttcgttttttattcgttggcggcgtttcggtcgttcgtaattgatttaattcgttttttgcgtttgttttttaggtttttcgtttttttataaaggtttaggggagtttcgtttataggttgattttgtaatttttggttcggtggttattttttgtttttttgaaaaagaaaaggaaaaaaaaaaaaaaaaagaaaaaattaattagtcgagggaggcgcgtgaggattggaggcgttagtcggatagtttatgagtaggtttttgggtcggtgtcgtttcgcgggttagtacggttttttttagagaaaattttttaa

SEQ ID NO: 33 - DNA, 616 bp, Artificial Sequence
  bisulfite converted genomic DNA
ttaaaaaattttctctaaaaaaaaccgtactaacccgcgaaacgacaccgacccaaaaacctactcataaactatccgactaacgcctccaatcctcacgcgcctccctcgactaattaattttttctttttttttttttttttccttttctttttcaaaaaaacaaaaaataaccaccgaaccaaaaattacaaaatcaacctataaacgaaactcccctaaacctttataaaaaaacgaaaaacctaaaaaacaaacgcaaaaaacgaattaaatcaattacgaacgaccgaaacgccgccaacgaataaaaaacgaaaaaaaccaacaaccgaaaaaaccccgacctaaaacgcctcgtatccccgaacctattaacgacgctacaaacccaaatcttaaaacgcgaactaaatcccccttaccaactctaaacaaaattcgaaaaaaaataaatcgaccaatctaaacacaaaatactctcgactaccgaacgacgaacgaaaacgcaaaaaccctaatcgcccccaaaaatactaaacgcacaaaacaataactacaaaaccccgacgcgaaaccaactcgaatcatccacgttaaaacctcaacctaccc

SEQ ID NO: 34 - DNA, 616 bp, Artificial Sequence
  bisulfite converted genomic DNA
aaacaaactaaaatcccaacgtaaataatccgaattaacctcgcgccgaaactctacaaccactaccctatacgctcaacacctctaaaaacgatcaaaacccctacgcttccgcccgccgcccgacaatcgaaaacaccctatacccaaactaaccgactcattctcccccgaattttatttaaaactaacaaaaaaaacttaactcgcgccccaaaacctaaacttacaacgccgccaacaaacccgaaaacacgaaacgctccaaaccgaaatcttcccgactactaacccctctcgctccccacccgctaacgacgcctcgatcgcccgcaattaacccaacccgcttcctacgtttacccctcaaatttcccgtttctccacaaaaacctaaaaaaacctcgcccacaaactaaccctacaacctctaacccgataactaccttctacttttctaaaaaaaaaaaaaaaaaaaaaaaaaaaaaaaaaaaaatcaaccaatcgaaaaaaacgcgtaaaaactaaaaacgccaaccgaacaacctataaataaatccctaaatcgataccgcttcgcgaatcaacacgacctttctcaaaaaaaacctcctaa

SEQ ID NO: 35 - DNA, 616 bp, Artificial Sequence
  bisulfite converted genomic DNA
ttaggaggttttttttgagaaaggtcgtgttgattcgcgaagcggtatcgatttagggatttatttataggttgttcggttggcgtttttagtttttacgcgtttttttcgattggttgatttttttttttttttttttttttttttttttttttttagaaaagtagaaggtagttatcgggttagaggttgtagggttagtttgtgggcgaggtttttttaggtttttgtggagaaacgggaaatttgaggggtaaacgtaggaagcgggttgggttaattgcgggcgatcgaggcgtcgttagcgggtggggagcgagaggggttagtagtcgggaagatttcggtttggagcgtttcgtgttttcgggtttgttggcggcgttgtaagtttaggttttggggcgcgagttaagttttttttgttagttttaaataaaattcgggggagaatgagtcggttagtttgggtatagggtgttttcgattgtcgggcggcgggcggaagcgtaggggttttgatcgtttttagaggtgttgagcgtatagggtagtggttgtagagtttcggcgcgaggttaattcggattatttacgttgggattttagtttgttt

SEQ ID NO: 36 - DNA, 72 bp, Homo sapiens
gcctatgagtaggtccctgggtcggtgccgcttcgcgggtcagcacggcctttctcagagaaaacctcctaa

SEQ ID NO: 37 - DNA, 72 bp, Artificial Sequence
  bisulfite converted genomic DNA
gtttatgagtaggtttttgggtcggtgtcgtttcgcgggttagtacggttttttttagagaaaattttttaa

SEQ ID NO: 38 - DNA, 72 bp, Artificial Sequence
  bisulfite converted genomic DNA
ttaaaaaattttctctaaaaaaaaccgtactaacccgcgaaacgacaccgacccaaaaacctactcataaac

SEQ ID NO: 39 - DNA, 72 bp, Artificial Sequence
  bisulfite converted genomic DNA
acctataaataaatccctaaatcgataccgcttcgcgaatcaacacgacctttctcaaaaaaaacctcctaa

SEQ ID NO: 40 - DNA, 72 bp, Artificial Sequence
  bisulfite converted genomic DNA
ttaggaggttttttttgagaaaggtcgtgttgattcgcgaagcggtatcgatttagggatttatttataggt

SEQ ID NO: 41 - DNA, 71 bp, Homo sapiens
gggcaggctgaggtcccaacgtggatgatccgagttggcctcgcgccggggctctgcagccactgccctgt

SEQ ID NO: 42 - DNA, 71 bp, Artificial Sequence
  bisulfite converted genomic DNA
gggtaggttgaggttttaacgtggatgattcgagttggtttcgcgtcggggttttgtagttattgttttgt

SEQ ID NO: 43 - DNA, 71 bp, Artificial Sequence
  bisulfite converted genomic DNA
acaaaacaataactacaaaaccccgacgcgaaaccaactcgaatcatccacgttaaaacctcaacctaccc

SEQ ID NO: 44 - DNA, 71 bp, Artificial Sequence
  bisulfite converted genomic DNA
aaacaaactaaaatcccaacgtaaataatccgaattaacctcgcgccgaaactctacaaccactaccctat

SEQ ID NO: 45 - DNA, 71 bp, Artificial Sequence
  bisulfite converted genomic DNA
atagggtagtggttgtagagtttcggcgcgaggttaattcggattatttacgttgggattttagtttgttt

SEQ ID NO: 46 - DNA, 68 bp, Homo sapiens
ccaagacctgggcttgcagcgccgccaacaggcccggggacacgaggcgctccaggccggggtcttcc

SEQ ID NO: 47 - DNA, 68 bp, Artificial Sequence
  bisulfite converted genomic DNA
ttaagatttgggtttgtagcgtcgttaataggttcggggatacgaggcgttttaggtcggggtttttt

SEQ ID NO: 48 - DNA, 68 bp, Artificial Sequence
  bisulfite converted genomic DNA
aaaaaaccccgacctaaaacgcctcgtatccccgaacctattaacgacgctacaaacccaaatcttaa

SEQ ID NO: 49 - DNA, 68 bp, Artificial Sequence
  bisulfite converted genomic DNA
ccaaaacctaaacttacaacgccgccaacaaacccgaaaacacgaaacgctccaaaccgaaatcttcc

SEQ ID NO: 50 - DNA, 68 bp, Artificial Sequence
  bisulfite converted genomic DNA
ggaagatttcggtttggagcgtttcgtgttttcgggtttgttggcggcgttgtaagtttaggttttgg

SEQ ID NO: 51 - DNA, 24238 bp, Homo sapiens
agatacatagaggttaggggtacaggtttggggatcaaagagacctagattaaaatctttgctctgccatttatcagaactgtgatcttagagagtttactcaatttctctgtcctaggtaggcttattatttgcaagcaacagaaactgagcatggttaatataagcaggaaagtaatttattggaaagacaaccaattacacaaagaatcaacaggaaggctgccagcaggaaattcaggcatggtcacaccatcctaaccaagtagtagttagcatgcctcaaccaacagccattatcactgcaggacccttgacaccacaaaccccagacatactgctgctgtgaatgacttctgaaattgctcttacgtctttgcgccactccttcaagattaaatttctaaacagtggtatctgataagtcaagcaaaggtcatatgctcaagccgtggcagaggatggaaggagaaaatccagcccatttagcttctctcatggcaggctaggtcttgcctccaaataatattatgcaatggaggattcttactaatagaaaaggagttcagctgctgggcagcctttcaaaactgacaacacctgggctgggtgtggtggctaacccctgtaatcccatcgctttgtgaggtggaggcttgtggatcgcctgagcccaggagttcgagaccagcctgagcaacatggggtaactccatctccacaaaaaaatacaaaaattagccaggcatagtggcacctgcctgtagtcccggcttacttgggaagctgaggttcactggaccccaggaggtggaggttgcagtgagccaagatcgccccactgcactccagtctgggggacagattgggaccctgccacaaaaaaaaagaaaaaaaaaaacactcccagcattcgttaaccaaactttgatttgctcatctgtgaaatgggcatctgactgcctagtaccttcctcataggtttgctgtgagaatttgacagcgtatgcatgttgcagttagcatgatgtctcacataggctgagcattggataaatttcagctattcttactaattcttgtgactctcagcaagccacatagaatctctgtgcccacattctcactcactgaaggaagattacatcaaccatactaaattagtcagcataggctaactgctgaaacaagggacccctcaaatctcagtgcattatttctcattcacttcattgtccagtgagggttgctgggattggaatgaggtccatacaggcactcagaggccaagtcaccttctatctagtggctctgccatatacccgggacctgtattatgttggcagaggacgaacaatagcacaaaggactgggttttatagggacccagcctggaagtggcatatatcaattctacctctattccattggccagaattcagtcacatgagctgcacctaaccacaagaagtcagtttgggaaataatacgcagctatgtgttccagaggaaatggaaacaagatttggtgcaacacagcagactctgtcacacctacctaacctcctcagagggttgctaataaaagcgcatgtgaacgccaagtgtgaaactgctatggaaagtgataaactaacatgagctacaggtgatgctgctgctattgattaagccagggagtttctgtgcatcctccacattgctaaaacatacagcaatttgggtatgagaagaaaccgaaatataatcagaaggtccttcctcctgtaggggagactctttaactagtaaggctttatttctccacttgtatcttcaaaaatgggccactctgggagcggtgactcacgcctgtaatcccagcactttgggaagccgaagggggtggatcacaaggtcaggagttcgagaccagcctggccaatatggtgaaaccccatctctactaaaaatacaaaattagccaggcaaggtggcacatgcctgtaatctcagctactagggaggctgagacaggagaattgcttgaatccaggaggcggaggttgcagtgagccaagttgcaccactgcactccagcctgggcgacagagcgagaatctgtctcaaaaaaaaaaaaaaaaaaggccactgcaggtaaataatctcctttctttgcccattggtccaatccacatgggcgtgtggtgaaactggagggaaaaaaagggagcgagcagaataaaagagcagaaagctattactttgaggagtgtaattgtcagagcaggctgtcagagcagcctgaagcaatcactcagtaggggccagcctccacagcagtaatttatcaccacatgaagatgttggggagttaatcacagcactgacatgtgtcagctccaggcattgggctcagcataaacttcatgcttagaaaatgaaaataattaagagggcacacatttgaaatgtaccactaaaaagggaaggcagtcatcttagggtcaggtgaatgccatgtttgtaatccactaaaccaactggaagagcctgtggagggcaaatgtgtccaagggtactttgctatttgtacctgatagatgcctttcacactgttttgagtctctgcatggcctgtcatgaaagagaaaagcaaacacaatttgcacaggctttgctacatgaatattagtgcttcaggaatgctctaagatcctgccagctgcggctcaggaaggggtccaggccagatctgactcatcctgctgccttcctcctggaaatgatcccctttctcaccccactcctgctggctgagcccaggtcctgtctgtcccatatttcctttgatccaaggaaaactaaaagtggttactagctcccaagcggcctttgtttataaatgggttcccaccttaatatgtttactcaaaaaactcgtcaaataattagctataacagagcaatcaaactgatcaaacagttcttggagtagttcaaaccttcagagagttatttaatgacagttttaaataactgaactggggtcttccagcatagagaagtagggattgtggcagaaactgcgagggagaatttttaaagtgcttagaataaaaatcttttcattgaaaaaaaatgacaagaattgcccacataattatggcaatttttcctttccttttgcaatgcaaattcctggcagagtgtaagagaaactgagctccactgtcccagtttttcaaactaagaaaataaaataatttgctacctaaactttcaacttctacttttgaaagctaaatttaagttttaagaatcgtacaacaaaagagactacagataaacctcattacaattttttagtattgagcattaggttatttattttccttcttcctaaagctactgtagaaagaaaattcaaaggactagtaagaaaaatagctcaattgataacaagtctggtttgtcaatgacatgctaatacctgtaacagttactaattatctcagcagtgtgtctcagtttttatatttaatatattcttcatcattcttaaattaataaatagcaaccaattgttttctcttttacaagcttcatatggaaagaaaattgaaaaaaaaaatttgtattagcagaaagtgaatataagggacttcccaacctcccctccatatatttactgacaagcaactgacatgagtgatagcaaagcaatgtggttagtgaggaatggcgcagagtgtgcagtttccttttttctaatgttgatttgttttctgtgctgacacaatcctagaggttactgttcaaaggaagcatcgacaacagaagtgattagagtactgattaaaagaagatttttaagaaaatgaccaatcaccatcaatcttaatattggctaacaaatgtgtatttttctttctcatattattaagtaaatagtataaacagaataattctttattagtatatccatatagtgccttttgcaagtaaatatgattctggatattttatgacctgtaattacttgaaatcggaaagcccttttagtttctcttattacccatgtgttgctgagactaactgaagaaccagttaggaggtttgttcgttcacgaaataacatttaagaaatgggtacctgcttatcacataaaagaatccagttatttacttaccctgtgaggagacataatatgttagaatgcttgtacactgcagatgggaagaggtttttccaggaatttaaattgtgcaataaggccacacaatcttacttaaaaaaaatggtgaaggggttttaattacaccatgaagttttacaattttttaggtttttagttctggttttagaaaacagagtagaaggattacagagaaaaacttcaccattagacaagaagtcaaaatgattctaagggccgcgcaaacaggcttttccaagaattaatcatgaggtggtgcttggagaattcctttactccagtgactttgaaacccccttctcactctccactagtctttcaaaggattcatggtgaattgggtctaacgagtataacacggccggccgaaggcatgaagctcacgctaccctttcagggcggagaagttcccaggaggaagaatggagaaaaagatcgcagttaggcagtcctcccaacctcaccaaggctccacctctctccaaagccgcaaggctctgccacctgcgccgggagaggctgcaatcactgtctcctcctctttctttctcttttttttttttcttttttgcctggggtgcccgaccaagcgcagcccgcagtctgggcactgccaactgactccaactccttttatggtgagaggatggattcttcgttatttccccgcccaatctggtacccacccacccacccacctaccacgtccgctgggcgcacccaagtctaaccccggggcgcacgcgctagcgcagacaccgtatttcttctcctttctcggccaaccctaggtagaatcctaaaacaactgccctctcttccacgatctagatgttgcggcccgcggacaggaggttcaagaaatagtacactccgagcggcaggcagcgaggcggaaacggtcgccggtttcagtggtggccccactggaagccgagttcaggagcggctaagcggtcgccggggaaagcaccggggcttcccagggtcccctccgagttcccactccgcacctccgagggcgtgaaaaccacgggagccgccccaccccgcgcgcccagccccgccccagcccagacaccgccccccgccagtcttccctgcggcgcccagggaggacgcgctccgcccccttccaatccggccaatgggcgcccgggcagcgcgcggtttgcctccgcctccgccagggaaacttggaggaggagaaaagtttgtacagagggtggaaaggcgagagcggagctccaagcccggcagcccgagaggaagatgaacagccccaggccagagcctctggcagagtggaccccgagccgcccccaggtagccaggagcggcctcagcggcagccgcaaactccagtagccgcccgtgctgcccgtggctggggcggagggcagccagagctggggaccaaggctccgcgccacctgcgcgcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacaggtgagatggcgttgggctgacgttggggtcaacgggtagagaacgcagggatgcggccctcgccgaagagagccaagaagggaagagcgcgctctccaaattgcttttgtaacttgttttcagtgagcattttattgattcagaatctatcgagaatagcactagcgagctacttttcccttgagatgggtcttattcatcttggcaatggagtgagttggattgtggggaggaagaggaatgggaaaatcagtttataaatattaatgtcagcaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgcaaaacctgaaatgtcagggatggtgatctgttcgttgtaaaccatttttaaggaaagtggggtttttggtgttttgatgtatgcaaggtttcttgaatttcttcccccgtggattgcgtagaattttaaagctagaagagatatcaagaggtgttttagtctaactccctcacttcactgagggagtgaatgatacgcttaaaataatccagccgaacctacacagtcaagctaggctccctgctctttaccatggtgtgccctgggagggcagcttaaagcacacaaattctaattcatatacagggcagggtccagactcagtttctttcattctgtctagaccaggaaagcaaagtttctcagggtgactaattatggacaggctgatatacatagggtatgggatttgaattctcgacaactgtgcgaggtacagtaccattttagagaaaccgaggtttagagatggctgtctttgtttcttcaagccaaagctctacagcttgtaatggaccttaggccgtctgaggccagacccagctcatgtgttattacatcacgtctccctcgtagaacatttctcattttggcgtttgtaaagcgtgggttggagttttggtacacttcatttttagttcatcttttaagaattgcctttggattaacttttaaaatatgataaacagaaaggctcaaaccctacctagttttctactttgcctgtggctaaaatggaatgcaccagaagcagatgggcagaataatgcaatactttatctagagtttctcttgaaagcaactagttatgagttcttccatcttccaaaacactgcattcctggaaattctaaactaccaactcaaaaagagataactgctttttcttatgcttgttgggaacaagagaatataaaatgtaatgggctattattccttccttttccttattgatactgtccagggatctttggtgtaaaaatatatctttgataaaagtgactgtaaatggaaggaacttagagggggctcagagccagaatacagtaggttcttaccaatttgtataaacagaagtaaatataataggccataagagcctttaagccattccaggacccaatataatttacagagttaagtcacacttgagccacataaatatattttactgtctgtaatggcaacctagaataaagtgagattttggaagaaacaacactgctcctgatggggcccctgttcctgggcctctgccttgtgttttacagaacagtaaatgacaaagtgaatggttgttattttcagaacatccacttaaagggacagaggaattagagctagaaggttagcaacatgcacatactttataaatgtgttttggttggaagtaagcatgtaaagctatggatttctgcacagccacggatgaattattttcttccaacatctagagagacatacaaggcttaattcacctcataggctgaagtggtagacctggacctaagattcagggcccttacacaaagccttgaaattatttgaggacctagaggcaagaaattataggagctgtatttgtggtttgcagattaaccacattttaactaacaagaaatactgtccacctgtataatgttagtaacgtgtagtaaattttaagtaatcttgacctgaaaattgaaactagctcaattaagaagtaatcccattagtcaagtatttatatagctttgtgagaaataaggaatcctaaaatagcagtggcatcagtttgtcgcctttagttttggctactaaagtctaatttcagaatcagtttaattataaattagtgataaatgatgggttcattatgccacccacccacccccccccccacaattcagcaattactgaaataatcaaaaacccttccgcaaatacagtcttccttggcttccttttacaactttcttttttcatgttttcatattcatgttgtaaattaagattaaagctcagaactctctgacattgaaagcagttgagcttatcttcagttccaaagaaactaatgaagcatctaattttatcaaatcaagtggttgctaatcccatttaaggaaaatcaaagcgttggaatcattttaaatgctttggaaaggctaacaaagcaaatgtagtttacttggaatttcagaaagcttgatataatacctaaggaaaacaagcagccactgaaaagcagccaaggttttgcctcctggacaccagggaagaaagagctacagctcttagaggggggttggtattgagtttagtataaaaaataaattttaatttgctatccaaaatatacatatttcataaatagagttaagattggagtggaaatttgagaaaggttgggaaattagttgtggatataaggaactgtgctgaacctgcagcattctttgaactgggtcataattaatgatcagagaaggtgtaagtatgatctacaaggaacatcacatgacaagatttagtgggtaggtggttcttgtcattttgtccattcttctatttataaccagtctcatagtttttttaaatataggagaattttggaagtgagaacttctaaaattttgtgagaacaagaagtgagagtctacatttaagataaacgaaaaggattgaattctttagaaatatgcaagcaagacagcctcctaaggtcctggttttaaatgctgtagcttgatgaattactagtgcctaattttgcagttactaatgaatattaagatgattattataatcaaatattttgccttagggctaaacagttactatagggtttcgaaggtcattttcccccatacacaagcaacccaagactgtatttattgcttacttgtttcttttattttttaactctgaagtaacaaatactcatctcagctaggggcagaacagctaatttgattaatcttctgccttggtgaggtaaaacttaggtccttaggaaaatacttcctgtgactgtttatttggttccttactataaactagttgtctctataaagctttcaccagcatttgatcagcaaaagtttataaggacagataaaaactttgtaaatagatatgcttttgtttactgtaggcaaactggaagtggagtcataaaacaactgatgggatgtcagatgagtgtgaagcacatctatacatacaagagaaatgccacaaatttgggtatgactatgacagaatctaaaagactggatttgttcaaataaatttggctaagtttaaaaaattgcaatgcctagaaggaagttttaaatcataacatgcaattgcagacccagtagtagtaacctgaagactattgagtaacataaaagtaagttatttccacatctggcatttcatttgaatcttgaaaagctctaaggagaaagtagggctgaccagtattttcactctctctacacctcagtttcccaagctgcaaatgaagaatttatatcattctgcaacttacagggtagctataggtgagtcctcgtctaatgctcatttcaccatgctttcttgacctgtcaatttgtttgtattgaatatctcctaacaagattttttttctcagccctgacgtgattcttgtagtctcctatcagaatattcaatgtgagagctttaaaaacaaacaaataaaaaaaaacagaaactttcagtgtagaggttgacctataaagcctgtagagatttaacttgccttctacaaatggccagaagaagaaccaagctctcctacacaccacccagtcaataattatttccactattctttacttgaaaaaaagaaagtgataagaacttctagtaacagctgtgtcaattttggactcttaacaaggcagtgggataactgagcccatacagataattccttttatgtgcttggaacagaacaagtagcacacacattcaaatccagctacagatcttgtcacttattggaaagcgttactgttttgacagtccattactaaatctaatcaagagttcaacattctttcttcaacattccctgcaaacaaattattaagtaggaagtacatgtttttgataccatattattaactatatcccaaagctacctctaagctacagttttcaaattattgataccttccacactgggcaagcttccacatatgggttgaaagaaaaagtaatgagagccaacatatctgttatacgataggcactgtactaagcactttaataatttgtacatacgttataagggcagagccaggatttgaacagaggcttgtttgcttccaaagcttgggcatttatctctacagcatatagcctccttacagctttcttgtcaccacatcttcttctgaacttattgcatttcctcaaagttatgttccactgctcctgagccctaatctctaatcatcctaaaaaaaagtgtgaataacataatttaaaaaaaattaggtgggtgtggtaacatgtgcctgtggtcccagcaacttggaaggttgaggctggaggattgcttgagcccaggaggttgaggctgcaatgagccatgtttgtatcacagcactccagcctgggtgacagagtgagaccctttctaaaagaaaataaaataatttagaatactgtaatatgccaatattaacaacaaaccacatgtacacagcaggagctactagaaaaagacttaaaattggaagaaaggagatacgttgtttgtattcagtgagtttttttgtttttgtttttgtttttgtttttgttttgagacggagtttcactttgtggcccaggctggagtgcaatggcgcaatctcagctcaccgcaacctccacctcccgggttcaagtgattctcctgcctcagccttccaagtagctgggattataggcatgcaccaccacgcccggctaattttgtatttttggtagagactgggtttctccatgttagtcaggctggtctcaaactcctgacctcaggtgatccgcctgcctcagcctcccaaagtgctgggattacaggcatgagccaccatgcccggccatattccctcctgactcggaggttcagttttatcagcaacacactcttccaacactgaaaactgcctgaacttgtttaattatgtaaaatatagggcctgttggacaagaattccgaaaagtgctttcaccccctcacgagacattgaagcactactccggatgtccccatctcaactggggttgtccctgccctcttggaaacagcaaatcaagtagcctacttaaagtgaagcagaggttgctctatgttttcaaacattgcaagatgcgtggagtttttgtttgttttgtcttttttctttccctacttgaagtaagtctcaattgaaatacgctgcaaagtaaaactcatattgattcttttcaatctaaccaacttttgaggatgtttttacctgaatttggacttttgctttttaaactcatacttttactaccctgtgaactcccctttattgaaaagacattgaatgaccaggttcagtggcttgtactaattgtaaacttttcctcccccatggaaaactttaaaatagagcatacttttaatatagcctcctttcattccctcctatactagtcgaaatccattgctgctgtggatgagatgaggcacagaaatgattctttccttgcctctcatcacctttgattatgaaaacctattattaattgttttacaacattccaacctttctaaaaggccacagaaattttaaaatgctaactcctaatgtacttctttgaatggctataaattccattttaactattcaaaaattttcttcctttcagtagtagccatgtttcctttgaggttgtggtaggagaagcaaccagcaataaaacattttcagtgtcaaaaatctcagaaacgtcaggttcagacttaaccaaaattctgttctgcgagtctcggagatggctttacacagtgcttgttagggaggtagtatcagaaactctcaagtggagcaacactgccacctggaggcttgaaggctcaagttcgcataaacccggccgtaggtcttttccagagaccacacacaggacttgatactaacagatttaacgccatcatttcttctacccttaggaacgtagtatgtgatgtgaataaaatatagacctcatgctttttaccaacaattccattgtcaggaaataataattaaacagaaagccagactggtagaacagaaaaggcaacatggaggtccagaccagactctgccaccaacagggtgggggacatcctaagttcctcaaaacctctgggtctcagtaacaaatacctcatctgagaaaaggcctgtagagttgagggaactgctgagtttccaggcatagctgaagacctcaaagcttatggaaggaagaaaccaagatgctttattttactttctgtaaagatttttttttaaatcaagtatgctttgccttgatactatcatttatcccagcgtagtttctaaaagtatttcaagaggcgatattacacactgctgttcattctagttcattcttgatttagctgtcttccatataggaagatattaatttcatcttggttagaggcatgtcactattttattctctgagatttacaggcccataatcccatatccaaaatatttacgggcagatgagtttcagaattcagaatttcttggcttttagaaaagtaatcaataatatattgcaaaatatgtaatatccccatcagaactggaacagtaatcctggaccagaacataggaatattcactctaagtggaataaattgaactaaatggcttcacagtctgttcagttcagttttgctgccaaaataagtttaggtcagattttgcaatgagtgtaagttctcaaaacaaaacaagtgaataacaacaaaacaataacaaaggaaatgaacaaaaatcttttgagagaggatcagagacctatagctaattaagatctaaattccagttaaggaagaaaaagaaatgcagttctaccttactgatccagtatcatccaggagtaagtttaatataagcttgattttgcagattaatgaaatgtatttcttcgaatattttaaagattcaaagaatctttaaaggaagaaaaaaataattcttccttcttttacccaaattttacccaaattgttgaaaatctttctataatatcctgacccaaatattgttacatctagtaagtgccaaaggaacacatgcaaatggtcaatgaatcgccttttccgttgtgaactgactcagcctcaactaaactgtccctgttccaggtgattcatacaccatgagtcattcattgttacgctgtatatagtaaggcagcaacatcctcaagtcttgttagagatatttgcccctagttaaatggctccagctatgcttttgttagttctttctcctttttgtggtttttatgtatcttccttgactgtgagactcaacctcttctccctaacctaaaataattactaaaggcaagaaataattactaaataattacttaagatatatggcaattatttttatttctatactactatttctatttctatttctatgtgaattaccactactactatttctatattaattacagatgagatttttatataaatgatcccagtggaattagaagtaatatctaggcaaaaaaaaatcataatactttaagagtaaatttgaggctgaacatggtggctcactcctgtaattttagcactttgggagactgcagcgggcagatcacttgagctcaagagttagagaccagcctgggcaacatagaaagacctcatctctacaaaaataataacagttagccaggcatgatggcacacacctgtagtcccagctactcaggaggctacagcaggaggattgctggagcctagggggtcaaggctgcagtgagcaatgattacaccactgcactccagcctgggcgacagagtgagaccctgtctcaaaaatatatatacatgtacatttaacaaatgcattttcccctaaggattaaaatgatcatgtaagtttacacaaattcatgctccattcgctgaatcatttgaagttcccagatgttgacatatcatttcattcttccatgactttgcacatggagctacctctatttgaaatgtgatgtctttccttctaaatttagcaaattctcattcatccgttgtgattactataactggggaacagagtcatagagaaaataaaaactattctctggtcattctgggtaacaggagatcctgctgttggtgtaaaacttttcagcatattctttctagactagaataaaagaatcttggccttattctggtgattagatggttaattgacttataaaatgagtttcctttaaattatgtaaaatgacagctggaataagaaatcagtagcttttgggggaaaaaagttacttcattagaattacaaaaacttaaaagcactcacagaaatgaagttaataaagtgcttctcaagaacactttatacatatgtgacctgcactcacattgcatttttgtatactgtctttgctctagggaagataatcataagatagttacaaaaatattaaagctatacgaactcagaacatgtaattgcatttttgcagtgactggtttttatttttttattttttatttttaaacagattcttgctctgttgccctggctggagtgcagtggcatcatctcagctcactgcaacctccacccgccgcattcaagccattctcctgcctcaccctcctgagtagctgggattataggcgtgtgccgccacacctggctaatttttgtttttttgagacggagtctcgctctgtcgccaggctggagtgcagtggtgggatctcagctcactgcaacctccgcctcccaggttcaaatgattctcctgcctcagcctcccgagtagctgggactacaggcgcatgccaccacacccagctaatttttgtatttttagtagagatggggtttcaccatgttggccaggaggttctcaatctcttgacctagtgatccgcctacctcggcctaccaaaatgctgggattacaggcgtgagccaccgcacccagcctaatgtttgtatttttagtagagatggggtttcgccatgttggacaagttggtctcggactcctgacctcaagtgatcctcccacctcggcctcccaaagtgctgggattacaggcgtgagccaccgtgcccagcccatgactggtttttctgaggcttattatgtagcttcctcttttcctggaacttgttaccagaaatgaaggcagcttcctaatattgataaggtagacatagcatttatatgttttcccaattgattaatgatgaaatctaaatgtgcgatctcacttatgcaggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatcatcctacaactcacattagagaacatcctggcttttgagcacttttcaaacaatcaagttgactcacgtgggtcctgaggcctgcagcacgtcggatgctaccccactatgacagaggattgtggtcacaacttgatggctgcgaagacctaccctccgtttttctactagataggaggatggtagaagtttggctgctgtcataacatccagagctttgtcgtatttggcacacagcagaggcccagatattagaaaggctctattccaataaactatgaggactgccttatggatgatttaagtgtctcactaaagcatgaaatgtgaatttttattgttgtacatacgatttaaggtatttaaagtattttcttctctgtgagaaggtttattgttaatacaaggtataataaaattatcgcaacccctctccttccagtataaccagctgaagttgcagatgttagatatttttcataaacaagttcgagtcaaagttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaataacccataattgaagtgtataatataaaaaattttaaaaatctaagcagcttattgtttctctgaaagtgtgtgtagttttactttcctaaggaattaccaagaatatcctttaaaatttaaaaggatggcaagttgcatcagaaagctttattttgagatgtaaaaagattcccaaacgtggttacattagccattcatgtatgtcagaagtgcagaattggggcacttaatggtcaccttgtaacagttttgtgtaactcccagtgatgctgtacacatatttgaagggtctttctcaaagaaatattaagcatgttttgttgctcagtgtttttgtgaattgcttggttgtaattaaattctgagcctgatattgatatggttttaagaagcagttgtaccaagtgaaattattttggagattataataaatatatacattcaatctgagttgcatatcctcagtttgggaaaacttgtgggggcttttttgttgtttcaggtcatcatctatatccttttatatatttttttaaaatttattgtgaaataattttaaagaaatattgcaagaaaagtacaaactcttgtatacacttagtagagaatgacactttactcaaagcctccagtttgtatgggtgatggaggagacagtattatgcttagcttgtgacatataaaggactcaaataattattactaaaatgagcatattttaaattttgcagtttttttaactgccatttttatttttatttttttattttttatttttgagacagagtcttgctctgtcacccagactagagtgcattggcacaatctcagctcactgcaacctccacctcccaggttcaagcaattctcatgcctcagcctcttgactagctgagattacaggcgtgtaccaccatgcccagctaaattttgtgtttttaggagagacatgtcatgccatgttggccatggttggtctcaaactcctggcttcaagcagcctgcccacctcagcctcccaaaatgctaggattgcaggcatgagccaccatgcccggccatttttacatttttaaatgcaaattttgttcattttttgagtgagttatatatctgcattagtcagctaaggctgccataaaataccacagatgggtggcttaaacaacagacatttattttctcacagttgtggaggctggcagtccaagaccaaggtgtcagcagggttggtttctcttgagccccctctccttgacttgcagatggctcccttctttctgtgtcctcagatagccttttctccaggtgagcacatccctgatgtctctctctccttataaggacactagtcatactggattagggccccacccttatgacttcatttaaccttaattactctcttaaaggccttctctccaaatatagtcacaatgagggttagggcttcaacaaatgaattttgggggcaagtgtccttttcattgttgagcctgatttattcttaaaatagcaaccaagaaaaatgaattccagcattgctcagtcatctattccatatttatttgtaaaacttaacagctatgcaatgcaaagattattttttgtttcttgctataggacacttgttccagaccatttagagaacttcaaattttctacacaggaaagttctgattgtctaattggctactattaaatcctaccatctcaaaaggatataacagacaagaaggtaattttaacaccatattgtaatctttgagacaatctaaccgattagatcaagtgtgttagaaaagatagatttgcaggactattaaaatggtactttaggccaggtacagtggctcacacctgtaatctcaacactttgggaggccaaggcagtggatcacttgaggtcaagagttcgagaccaggatggccaacatggtgaaactctgtctctattaaaaatacaaaaattggccaggcgtggtggcttacacctgtaatcccagcactttgggaggctgaggagggcagatcacgaggtcaggagtttaagaccagcctggccaacgtaatgaaacctcatctccactaaaaatataaaaattagacaggcatggtggcgggtgcctgtagtccagctacttgggaggctgagtgaggcaggagaatcgtttaaacccgggaggcgggggttgcagtgagccgagatcgtgcgactgaactctagcctgggcgacacagcgagactgtctcaaaaaaaataaaaaataaatacaaacattaactaggcatggtgccgtgtgcccagctactcaggaggctgaggcaggagaatcacttgaacccaggaggcggaggttgcagtgagccaagatcggccactgaactccagcctgggcgacagagggagactccgtcggaaaaaagaaaaaaatggtactttgtgcggtcataaaaaagaatgaattcatgtccatatcctttgaaccaatagaatgaaggtaaagaccactgtcctaagtgaactaactcagaaacagaaaaccaaatactgcatgttctcacttataaatgagagctatacaatgggtacacatggtcataaagatggaactgatgctggggactccaaaagtggggaggtgggggagagcaagggttgaaaaataacctactgggtactatgttcactatttgggtactgggtacactagaaacccaatccccaccagtatgcaatatacccatgtaacaaacacacgtactccccgaatctaaaataaaatgatgaaataaaaaataaaatggtactttgaccaagggaccacagaattcaagagttctttcccaaatcatagctagtcctctccacaagttttctcctaggggcatgaatacaaaagggacatggaaaaatcaaggcacagtaatatttactgttagctatccatatggcctcaaatgttaatgcagaaaaatttccattacacaaacattcagttttcctaaagtacttgtactagtctcagaacaaaccatgtttggtttcttccaatactgcccccacctcatgcccttctcccgttacatccaagcctgaatctaagatgctgcaattatgatctcaagattgtcatccagacacatgagaaatagaacccaaaaaaacaagacgcttacaacaagagagagcatttggtcccattgcttactgtggggtttctctgggctacagctggtgctttagccccaaactggaagtaccttggcagaaaggaagagagaaagatagctgggtctttggtccttctatcaacatctctaccattcaatcatttatccattccctttaccttgccaggccatcaaccccatttcccaccatggaagagaaggacagaagagaacaccagtcacttttcctaagaacgtttaaccacagcaactctacacactaaaatctgaacaattaggtaagtatttctctttcttgagaaggggtgaaacaggatttaatacaaaggaggagcaaaaagaattccaagaacaatgaacaagaactcaaggcaacagctctgcaatagggcaagagcacagtgaaaccatactgaggcaggagggaagtctctgtgatgtccccatggtaagaaagaaggaaagagagaaagagagaaagaaagagagagagagaaagagagaaagagaaagggaaagaaagagagaaagaaagagaaaacaaagaaggaaagaaaggaaggaaggaaagaaagaaaagaaagaaaggaaggaaggaaggaaagaaagagaaaagaaagaaaggaaagaaaaaagaaagaaaggaaggaaggaaggaaagaaagagaaagaaagaaaagaaagaaaggaagaaaaattaagaaagaaagaaaagaaagaaagaaagaaaaagaaagaagaaaagaaagaaagaaagaaagaaagaaagaaagaaagaaagaaagaaagaaagaaagaaagaaagaaagaaaaagaaaggccaggcacagtggctcacgcctgtaatcccagcactttggaaggccgaggcaggcggatcacctgaggtcaggagttcaaaaccagcctaaccaacatggagaaaccctgtctctactaaaaatgcaaaattagccaggcgtggtggcgcatgcctgtaatcccagctactcgggaggctgaggcaagagaattgcttgaaccccggaggcggaggttgcggtgagctgagatcatgccattgcactctagcctgggcagcgagcgaaattccatctcaaaaaaaaaacaaaaaaacaaagaaaaaagaaaaagaaggaaaagtaatagattatttgatgtttggcaaaatcaaagggagtgttatagttctattagaaaaattagtaaaaatatacataggaaactaatgaatttaaaaaaggcaattattgactccatgaaaaacaaagagaggtggaaaaaaggcaaaataaacataatatacaaggtgaactaaattatgtgtaataagtatactcatatcaaataatgaatatacagtcaggtacagcggctcacacctgtaatcctaaagctttgggaggctgagacaggattgcttgcacaaactccttttgtgcagccataaaaaagaatgaaatcatgtcctctgcagtagcacaaatggaactagagaccattgtcctaagtgaactaactcagaaacagaaaaccaaataccacatggtctcacttgcagagttcaagacctgtctgggcaacacagtgagagaccctgtctctacaaaaaaaaaaaaaaaaaaaaaaaaaaaccatgaaaaattagccaggcatgggggcatgtgcttgtagtcctagctactcgggagactgaggcaggcagatctcctgagccatgaatttgaggttacagtgagctaagatggtgccactggacaccagcctgggcaacaaaccaagaccctgtctctaaaatttaataataatcatcatcatcatcataaacatagattgaaacctaaattataattatactgagaatgaagaaagaagtagtaaatatattggggaaatacaagagacctaagttatagttatactcatcagtataccagtacttaatgtcctaaatttttaaaaatgaagaaatagcagtgaaaccacaataatatacccttatactccaaacatgtttgcaaaatatgtaaagtatgaaaataccaagtatgcttcaaaaaatatactgttcttgggaatacaaaattgatacaaccactttgaaaagtgaactaaagttcaggatgtatatgccatcaatgaaaacagtaactgccgagattgaaacacatcaattatatctcaatgcattactttatgatacgacaaaacaaaacacctcattggtcacctttggaggagtctagggag

SEQ ID NO: 52 - DNA, 24238 bp, Artificial Sequence
  bisulfite converted genomic DNA
agatatatagaggttaggggtataggtttggggattaaagagatttagattaaaatttttgttttgttatttattagaattgtgattttagagagtttatttaatttttttgttttaggtaggtttattatttgtaagtaatagaaattgagtatggttaatataagtaggaaagtaatttattggaaagataattaattatataaagaattaataggaaggttgttagtaggaaatttaggtatggttatattattttaattaagtagtagttagtatgttttaattaatagttattattattgtaggatttttgatattataaattttagatatattgttgttgtgaatgatttttgaaattgtttttacgtttttgcgttatttttttaagattaaatttttaaatagtggtatttgataagttaagtaaaggttatatgtttaagtcgtggtagaggatggaaggagaaaatttagtttatttagttttttttatggtaggttaggttttgtttttaaataatattatgtaatggaggatttttattaatagaaaaggagtttagttgttgggtagttttttaaaattgataatatttgggttgggtgtggtggttaatttttgtaattttatcgttttgtgaggtggaggtttgtggatcgtttgagtttaggagttcgagattagtttgagtaatatggggtaattttatttttataaaaaaatataaaaattagttaggtatagtggtatttgtttgtagtttcggtttatttgggaagttgaggtttattggattttaggaggtggaggttgtagtgagttaagatcgttttattgtattttagtttgggggatagattgggattttgttataaaaaaaaagaaaaaaaaaaatatttttagtattcgttaattaaattttgatttgtttatttgtgaaatgggtatttgattgtttagtattttttttataggtttgttgtgagaatttgatagcgtatgtatgttgtagttagtatgatgttttatataggttgagtattggataaattttagttatttttattaatttttgtgatttttagtaagttatatagaatttttgtgtttatatttttatttattgaaggaagattatattaattatattaaattagttagtataggttaattgttgaaataagggattttttaaattttagtgtattattttttatttattttattgtttagtgagggttgttgggattggaatgaggtttatataggtatttagaggttaagttattttttatttagtggttttgttatatattcgggatttgtattatgttggtagaggacgaataatagtataaaggattgggttttatagggatttagtttggaagtggtatatattaattttatttttattttattggttagaatttagttatatgagttgtatttaattataagaagttagtttgggaaataatacgtagttatgtgttttagaggaaatggaaataagatttggtgtaatatagtagattttgttatatttatttaatttttttagagggttgttaataaaagcgtatgtgaacgttaagtgtgaaattgttatggaaagtgataaattaatatgagttataggtgatgttgttgttattgattaagttagggagtttttgtgtattttttatattgttaaaatatatagtaatttgggtatgagaagaaatcgaaatataattagaaggtttttttttttgtaggggagattttttaattagtaaggttttatttttttatttgtatttttaaaaatgggttattttgggagcggtgatttacgtttgtaattttagtattttgggaagtcgaagggggtggattataaggttaggagttcgagattagtttggttaatatggtgaaattttatttttattaaaaatataaaattagttaggtaaggtggtatatgtttgtaattttagttattagggaggttgagataggagaattgtttgaatttaggaggcggaggttgtagtgagttaagttgtattattgtattttagtttgggcgatagagcgagaatttgttttaaaaaaaaaaaaaaaaaaggttattgtaggtaaataattttttttttttgtttattggtttaatttatatgggcgtgtggtgaaattggagggaaaaaaagggagcgagtagaataaaagagtagaaagttattattttgaggagtgtaattgttagagtaggttgttagagtagtttgaagtaattatttagtaggggttagtttttatagtagtaatttattattatatgaagatgttggggagttaattatagtattgatatgtgttagttttaggtattgggtttagtataaattttatgtttagaaaatgaaaataattaagagggtatatatttgaaatgtattattaaaaagggaaggtagttattttagggttaggtgaatgttatgtttgtaatttattaaattaattggaagagtttgtggagggtaaatgtgtttaagggtattttgttatttgtatttgatagatgttttttatattgttttgagtttttgtatggtttgttatgaaagagaaaagtaaatataatttgtataggttttgttatatgaatattagtgttttaggaatgttttaagattttgttagttgcggtttaggaaggggtttaggttagatttgatttattttgttgttttttttttggaaatgatttttttttttattttatttttgttggttgagtttaggttttgtttgttttatattttttttgatttaaggaaaattaaaagtggttattagtttttaagcggtttttgtttataaatgggtttttattttaatatgtttatttaaaaaattcgttaaataattagttataatagagtaattaaattgattaaatagtttttggagtagtttaaatttttagagagttatttaatgatagttttaaataattgaattggggttttttagtatagagaagtagggattgtggtagaaattgcgagggagaatttttaaagtgtttagaataaaaatttttttattgaaaaaaaatgataagaattgtttatataattatggtaattttttttttttttttgtaatgtaaatttttggtagagtgtaagagaaattgagttttattgttttagttttttaaattaagaaaataaaataatttgttatttaaatttttaatttttatttttgaaagttaaatttaagttttaagaatcgtataataaaagagattatagataaattttattataattttttagtattgagtattaggttatttattttttttttttttaaagttattgtagaaagaaaatttaaaggattagtaagaaaaatagtttaattgataataagtttggtttgttaatgatatgttaatatttgtaatagttattaattattttagtagtgtgttttagtttttatatttaatatattttttattatttttaaattaataaatagtaattaattgtttttttttttataagttttatatggaaagaaaattgaaaaaaaaaatttgtattagtagaaagtgaatataagggattttttaattttttttttatatatttattgataagtaattgatatgagtgatagtaaagtaatgtggttagtgaggaatggcgtagagtgtgtagtttttttttttttaatgttgatttgttttttgtgttgatataattttagaggttattgtttaaaggaagtatcgataatagaagtgattagagtattgattaaaagaagatttttaagaaaatgattaattattattaattttaatattggttaataaatgtgtattttttttttttatattattaagtaaatagtataaatagaataattttttattagtatatttatatagtgttttttgtaagtaaatatgattttggatattttatgatttgtaattatttgaaatcggaaagtttttttagttttttttattatttatgtgttgttgagattaattgaagaattagttaggaggtttgttcgtttacgaaataatatttaagaaatgggtatttgtttattatataaaagaatttagttatttatttattttgtgaggagatataatatgttagaatgtttgtatattgtagatgggaagaggtttttttaggaatttaaattgtgtaataaggttatataattttatttaaaaaaaatggtgaaggggttttaattatattatgaagttttataattttttaggtttttagttttggttttagaaaatagagtagaaggattatagagaaaaattttattattagataagaagttaaaatgattttaagggtcgcgtaaataggtttttttaagaattaattatgaggtggtgtttggagaatttttttattttagtgattttgaaattttttttttattttttattagttttttaaaggatttatggtgaattgggtttaacgagtataatacggtcggtcgaaggtatgaagtttacgttatttttttagggcggagaagtttttaggaggaagaatggagaaaaagatcgtagttaggtagtttttttaattttattaaggttttatttttttttaaagtcgtaaggttttgttatttgcgtcgggagaggttgtaattattgtttttttttttttttttttttttttttttttttttttttgtttggggtgttcgattaagcgtagttcgtagtttgggtattgttaattgattttaattttttttatggtgagaggatggatttttcgttattttttcgtttaatttggtatttatttatttatttatttattacgttcgttgggcgtatttaagtttaatttcggggcgtacgcgttagcgtagatatcgtatttttttttttttttcggttaattttaggtagaattttaaaataattgtttttttttttacgatttagatgttgcggttcgcggataggaggtttaagaaatagtatatttcgagcggtaggtagcgaggcggaaacggtcgtcggttttagtggtggttttattggaagtcgagtttaggagcggttaagcggtcgtcggggaaagtatcggggttttttagggtttttttcgagtttttatttcgtattttcgagggcgtgaaaattacgggagtcgttttatttcgcgcgtttagtttcgttttagtttagatatcgtttttcgttagttttttttgcggcgtttagggaggacgcgtttcgtttttttttaattcggttaatgggcgttcgggtagcgcgcggtttgttttcgttttcgttagggaaatttggaggaggagaaaagtttgtatagagggtggaaaggcgagagcggagttttaagttcggtagttcgagaggaagatgaatagttttaggttagagtttttggtagagtggatttcgagtcgtttttaggtagttaggagcggttttagcggtagtcgtaaattttagtagtcgttcgtgttgttcgtggttggggcggagggtagttagagttggggattaaggtttcgcgttatttgcgcgtatagttttatatttgaacgttgttttttcgtagacgagatcggcgggtattgtaaagttgggattcgtttttgaaggaaaaaaaatagcgagtaagaaatttagtattattttttattgatttatttcgttgtattttttgttttttaagtttttgaaagttggtaattttgatttcggtgtttaaaaatcgatagttattgagatcggttttgagaagtcgaagatttggtagtttttagattgagtaggataaggtgaaagtaggttggaggcgggtttaggatatttgagggttgattttgggggttcgtgaggttgttatcgttgttgtcgttataggtgagatggcgttgggttgacgttggggttaacgggtagagaacgtagggatgcggttttcgtcgaagagagttaagaagggaagagcgcgttttttaaattgtttttgtaatttgtttttagtgagtattttattgatttagaatttatcgagaatagtattagcgagttattttttttttgagatgggttttatttattttggtaatggagtgagttggattgtggggaggaagaggaatgggaaaattagtttataaatattaatgttagtaagagtgtgttgttggtaggacgtatcgcgagtttggagattttggtggtcgtagttggtaagtggttataatttagaaagtaggatcgagttgttttttttgttttattagtgtatcgtttttcgggcgcgggtttaatattttataagtggtaattttcgtttacggtagttttgttttttttttattatttttagatttagttttgtattttaaggttgcgtatcgttagttattattatgtttattttcggggttaattcgttcgtttttttgagtttcgatcggttgaatagtttagtgattatttcggcggtgatgtttattttcggggtggtgggtaatttggtggttatcgtggtgttgtgtaagtcgcgtaaggagtagaaggagacgattttttatacgttggtatgtgggttggttgttatcgatttgttgggtattttgttggtgagttcggtgattatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgttttttagagtaggtttaattttttttgaagttttaattttaacgagatttagtaggtgttttgtttttatattttttagtttatgttttcggaagtttgggtttttttttttatcgagatagtttttattttttgttgtttgatattggtcgagttttttaagaaaatttttcgttttttttgttagacgtggaggggagtttgttgtagtgtgatttagtttattttttcgtattgtgaattgtgaattgtaaaatttgaaatgttagggatggtgatttgttcgttgtaaattatttttaaggaaagtggggtttttggtgttttgatgtatgtaaggttttttgaattttttttttcgtggattgcgtagaattttaaagttagaagagatattaagaggtgttttagtttaatttttttattttattgagggagtgaatgatacgtttaaaataatttagtcgaatttatatagttaagttaggttttttgttttttattatggtgtgttttgggagggtagtttaaagtatataaattttaatttatatatagggtagggtttagatttagttttttttattttgtttagattaggaaagtaaagttttttagggtgattaattatggataggttgatatatatagggtatgggatttgaattttcgataattgtgcgaggtatagtattattttagagaaatcgaggtttagagatggttgtttttgtttttttaagttaaagttttatagtttgtaatggattttaggtcgtttgaggttagatttagtttatgtgttattatattacgtttttttcgtagaatattttttattttggcgtttgtaaagcgtgggttggagttttggtatattttatttttagtttattttttaagaattgtttttggattaatttttaaaatatgataaatagaaaggtttaaattttatttagttttttattttgtttgtggttaaaatggaatgtattagaagtagatgggtagaataatgtaatattttatttagagttttttttgaaagtaattagttatgagtttttttattttttaaaatattgtatttttggaaattttaaattattaatttaaaaagagataattgtttttttttatgtttgttgggaataagagaatataaaatgtaatgggttattattttttttttttttttattgatattgtttagggatttttggtgtaaaaatatatttttgataaaagtgattgtaaatggaaggaatttagagggggtttagagttagaatatagtaggtttttattaatttgtataaatagaagtaaatataataggttataagagtttttaagttattttaggatttaatataatttatagagttaagttatatttgagttatataaatatattttattgtttgtaatggtaatttagaataaagtgagattttggaagaaataatattgtttttgatggggtttttgtttttgggtttttgttttgtgttttatagaatagtaaatgataaagtgaatggttgttatttttagaatatttatttaaagggatagaggaattagagttagaaggttagtaatatgtatatattttataaatgtgttttggttggaagtaagtatgtaaagttatggatttttgtatagttacggatgaattatttttttttaatatttagagagatatataaggtttaatttattttataggttgaagtggtagatttggatttaagatttagggtttttatataaagttttgaaattatttgaggatttagaggtaagaaattataggagttgtatttgtggtttgtagattaattatattttaattaataagaaatattgtttatttgtataatgttagtaacgtgtagtaaattttaagtaattttgatttgaaaattgaaattagtttaattaagaagtaattttattagttaagtatttatatagttttgtgagaaataaggaattttaaaatagtagtggtattagtttgtcgtttttagttttggttattaaagtttaattttagaattagtttaattataaattagtgataaatgatgggtttattatgttatttatttatttttttttttataatttagtaattattgaaataattaaaaattttttcgtaaatatagttttttttggtttttttttataattttttttttttatgtttttatatttatgttgtaaattaagattaaagtttagaattttttgatattgaaagtagttgagtttatttttagttttaaagaaattaatgaagtatttaattttattaaattaagtggttgttaattttatttaaggaaaattaaagcgttggaattattttaaatgttttggaaaggttaataaagtaaatgtagtttatttggaattttagaaagtttgatataatatttaaggaaaataagtagttattgaaaagtagttaaggttttgttttttggatattagggaagaaagagttatagtttttagaggggggttggtattgagtttagtataaaaaataaattttaatttgttatttaaaatatatatattttataaatagagttaagattggagtggaaatttgagaaaggttgggaaattagttgtggatataaggaattgtgttgaatttgtagtattttttgaattgggttataattaatgattagagaaggtgtaagtatgatttataaggaatattatatgataagatttagtgggtaggtggtttttgttattttgtttatttttttatttataattagttttatagtttttttaaatataggagaattttggaagtgagaatttttaaaattttgtgagaataagaagtgagagtttatatttaagataaacgaaaaggattgaattttttagaaatatgtaagtaagatagttttttaaggttttggttttaaatgttgtagtttgatgaattattagtgtttaattttgtagttattaatgaatattaagatgattattataattaaatattttgttttagggttaaatagttattatagggtttcgaaggttatttttttttatatataagtaatttaagattgtatttattgtttatttgttttttttattttttaattttgaagtaataaatatttattttagttaggggtagaatagttaatttgattaattttttgttttggtgaggtaaaatttaggtttttaggaaaatattttttgtgattgtttatttggttttttattataaattagttgtttttataaagtttttattagtatttgattagtaaaagtttataaggatagataaaaattttgtaaatagatatgtttttgtttattgtaggtaaattggaagtggagttataaaataattgatgggatgttagatgagtgtgaagtatatttatatatataagagaaatgttataaatttgggtatgattatgatagaatttaaaagattggatttgtttaaataaatttggttaagtttaaaaaattgtaatgtttagaaggaagttttaaattataatatgtaattgtagatttagtagtagtaatttgaagattattgagtaatataaaagtaagttatttttatatttggtattttatttgaattttgaaaagttttaaggagaaagtagggttgattagtatttttattttttttatattttagttttttaagttgtaaatgaagaatttatattattttgtaatttatagggtagttataggtgagttttcgtttaatgtttattttattatgtttttttgatttgttaatttgtttgtattgaatattttttaataagatttttttttttagttttgacgtgatttttgtagttttttattagaatatttaatgtgagagttttaaaaataaataaataaaaaaaaatagaaatttttagtgtagaggttgatttataaagtttgtagagatttaatttgttttttataaatggttagaagaagaattaagtttttttatatattatttagttaataattatttttattattttttatttgaaaaaaagaaagtgataagaatttttagtaatagttgtgttaattttggatttttaataaggtagtgggataattgagtttatatagataattttttttatgtgtttggaatagaataagtagtatatatatttaaatttagttatagattttgttatttattggaaagcgttattgttttgatagtttattattaaatttaattaagagtttaatattttttttttaatattttttgtaaataaattattaagtaggaagtatatgtttttgatattatattattaattatattttaaagttatttttaagttatagtttttaaattattgatattttttatattgggtaagtttttatatatgggttgaaagaaaaagtaatgagagttaatatatttgttatacgataggtattgtattaagtattttaataatttgtatatacgttataagggtagagttaggatttgaatagaggtttgtttgtttttaaagtttgggtatttatttttatagtatatagtttttttatagtttttttgttattatatttttttttgaatttattgtatttttttaaagttatgttttattgtttttgagttttaatttttaattattttaaaaaaaagtgtgaataatataatttaaaaaaaattaggtgggtgtggtaatatgtgtttgtggttttagtaatttggaaggttgaggttggaggattgtttgagtttaggaggttgaggttgtaatgagttatgtttgtattatagtattttagtttgggtgatagagtgagattttttttaaaagaaaataaaataatttagaatattgtaatatgttaatattaataataaattatatgtatatagtaggagttattagaaaaagatttaaaattggaagaaaggagatacgttgtttgtatttagtgagtttttttgtttttgtttttgtttttgtttttgttttgagacggagttttattttgtggtttaggttggagtgtaatggcgtaattttagtttatcgtaatttttatttttcgggtttaagtgatttttttgttttagttttttaagtagttgggattataggtatgtattattacgttcggttaattttgtatttttggtagagattgggtttttttatgttagttaggttggttttaaatttttgattttaggtgattcgtttgttttagttttttaaagtgttgggattataggtatgagttattatgttcggttatatttttttttgattcggaggtttagttttattagtaatatatttttttaatattgaaaattgtttgaatttgtttaattatgtaaaatatagggtttgttggataagaatttcgaaaagtgtttttatttttttacgagatattgaagtattatttcggatgtttttattttaattggggttgtttttgtttttttggaaatagtaaattaagtagtttatttaaagtgaagtagaggttgttttatgtttttaaatattgtaagatgcgtggagtttttgtttgttttgttttttttttttttttatttgaagtaagttttaattgaaatacgttgtaaagtaaaatttatattgattttttttaatttaattaatttttgaggatgtttttatttgaatttggatttttgttttttaaatttatatttttattattttgtgaatttttttttattgaaaagatattgaatgattaggtttagtggtttgtattaattgtaaatttttttttttttatggaaaattttaaaatagagtatatttttaatatagtttttttttatttttttttatattagtcgaaatttattgttgttgtggatgagatgaggtatagaaatgattttttttttgttttttattatttttgattatgaaaatttattattaattgttttataatattttaatttttttaaaaggttatagaaattttaaaatgttaatttttaatgtatttttttgaatggttataaattttattttaattatttaaaaatttttttttttttagtagtagttatgttttttttgaggttgtggtaggagaagtaattagtaataaaatatttttagtgttaaaaattttagaaacgttaggtttagatttaattaaaattttgttttgcgagtttcggagatggttttatatagtgtttgttagggaggtagtattagaaatttttaagtggagtaatattgttatttggaggtttgaaggtttaagttcgtataaattcggtcgtaggttttttttagagattatatataggatttgatattaatagatttaacgttattattttttttatttttaggaacgtagtatgtgatgtgaataaaatatagattttatgttttttattaataattttattgttaggaaataataattaaatagaaagttagattggtagaatagaaaaggtaatatggaggtttagattagattttgttattaatagggtgggggatattttaagttttttaaaatttttgggttttagtaataaatattttatttgagaaaaggtttgtagagttgagggaattgttgagtttttaggtatagttgaagattttaaagtttatggaaggaagaaattaagatgttttattttattttttgtaaagatttttttttaaattaagtatgttttgttttgatattattatttattttagcgtagtttttaaaagtattttaagaggcgatattatatattgttgtttattttagtttatttttgatttagttgttttttatataggaagatattaattttattttggttagaggtatgttattattttattttttgagatttataggtttataattttatatttaaaatatttacgggtagatgagttttagaatttagaattttttggtttttagaaaagtaattaataatatattgtaaaatatgtaatatttttattagaattggaatagtaattttggattagaatataggaatatttattttaagtggaataaattgaattaaatggttttatagtttgtttagtttagttttgttgttaaaataagtttaggttagattttgtaatgagtgtaagtttttaaaataaaataagtgaataataataaaataataataaaggaaatgaataaaaattttttgagagaggattagagatttatagttaattaagatttaaattttagttaaggaagaaaaagaaatgtagttttattttattgatttagtattatttaggagtaagtttaatataagtttgattttgtagattaatgaaatgtattttttcgaatattttaaagatttaaagaatttttaaaggaagaaaaaaataattttttttttttttatttaaattttatttaaattgttgaaaatttttttataatattttgatttaaatattgttatatttagtaagtgttaaaggaatatatgtaaatggttaatgaatcgtttttttcgttgtgaattgatttagttttaattaaattgtttttgttttaggtgatttatatattatgagttatttattgttacgttgtatatagtaaggtagtaatatttttaagttttgttagagatatttgtttttagttaaatggttttagttatgtttttgttagtttttttttttttttgtggtttttatgtattttttttgattgtgagatttaattttttttttttaatttaaaataattattaaaggtaagaaataattattaaataattatttaagatatatggtaattatttttatttttatattattatttttatttttatttttatgtgaattattattattattatttttatattaattatagatgagatttttatataaatgattttagtggaattagaagtaatatttaggtaaaaaaaaattataatattttaagagtaaatttgaggttgaatatggtggtttatttttgtaattttagtattttgggagattgtagcgggtagattatttgagtttaagagttagagattagtttgggtaatatagaaagattttatttttataaaaataataatagttagttaggtatgatggtatatatttgtagttttagttatttaggaggttatagtaggaggattgttggagtttagggggttaaggttgtagtgagtaatgattatattattgtattttagtttgggcgatagagtgagattttgttttaaaaatatatatatatgtatatttaataaatgtatttttttttaaggattaaaatgattatgtaagtttatataaatttatgttttattcgttgaattatttgaagtttttagatgttgatatattattttatttttttatgattttgtatatggagttatttttatttgaaatgtgatgtttttttttttaaatttagtaaatttttatttattcgttgtgattattataattggggaatagagttatagagaaaataaaaattattttttggttattttgggtaataggagattttgttgttggtgtaaaattttttagtatattttttttagattagaataaaagaattttggttttattttggtgattagatggttaattgatttataaaatgagttttttttaaattatgtaaaatgatagttggaataagaaattagtagtttttgggggaaaaaagttattttattagaattataaaaatttaaaagtatttatagaaatgaagttaataaagtgttttttaagaatattttatatatatgtgatttgtatttatattgtatttttgtatattgtttttgttttagggaagataattataagatagttataaaaatattaaagttatacgaatttagaatatgtaattgtatttttgtagtgattggtttttatttttttattttttatttttaaatagatttttgttttgttgttttggttggagtgtagtggtattattttagtttattgtaatttttattcgtcgtatttaagttatttttttgttttatttttttgagtagttgggattataggcgtgtgtcgttatatttggttaatttttgtttttttgagacggagtttcgttttgtcgttaggttggagtgtagtggtgggattttagtttattgtaattttcgttttttaggtttaaatgatttttttgttttagtttttcgagtagttgggattataggcgtatgttattatatttagttaatttttgtatttttagtagagatggggttttattatgttggttaggaggtttttaattttttgatttagtgattcgtttatttcggtttattaaaatgttgggattataggcgtgagttatcgtatttagtttaatgtttgtatttttagtagagatggggtttcgttatgttggataagttggtttcggatttttgattttaagtgatttttttatttcggttttttaaagtgttgggattataggcgtgagttatcgtgtttagtttatgattggtttttttgaggtttattatgtagttttttttttttttggaatttgttattagaaatgaaggtagttttttaatattgataaggtagatatagtatttatatgtttttttaattgattaatgatgaaatttaaatgtgcgattttatttatgtaggtgcgagtattcgttaattagttatattagttaagtttggagcgagaagttagtaaaaatttagatttgtaggttattcgaattgtttttgtgaattttattttagatttttggatatatatttttttgagaaagatagtgtttagtaaagtaatagagaagattaaatgttttttttgtcgtattggcgggtttcgtagggagcgtttcggatagtattgtttagatagttaaaggatattttttgttatgttaggttattttcgtttttttatttttcgggagttgaaggagattagtagtatattttagatttttttgttagattttttattgttagattttagtgaaaatggttttggaggtaggaatttgtttttaggtgtgtttggtatgggtttggtttaggaagatattattttattgaggattttgcgaatattagagattttagattttttatagggttaggatttagagagtgttttattggtggatgaggttggtgggagcggtagggttgggtttgtttttaaggggagttttttgtaagttatattttttagtgaaatattgaatttattagaaaaatgtatataataggtaaggaaagaaatatagtattgtttttggatttttataaaattttgtgtaatagatatatatatgttatatttagttgtgtttagaagggttattattattttataatttatattagagaatattttggtttttgagtattttttaaataattaagttgatttacgtgggttttgaggtttgtagtacgtcggatgttattttattatgatagaggattgtggttataatttgatggttgcgaagatttatttttcgtttttttattagataggaggatggtagaagtttggttgttgttataatatttagagttttgtcgtatttggtatatagtagaggtttagatattagaaaggttttattttaataaattatgaggattgttttatggatgatttaagtgttttattaaagtatgaaatgtgaatttttattgttgtatatacgatttaaggtatttaaagtatttttttttttgtgagaaggtttattgttaatataaggtataataaaattatcgtaatttttttttttttagtataattagttgaagttgtagatgttagatattttttataaataagttcgagttaaagttgaaaatttatagtaagattgatatttataaaatagatataaatttttaagagaaagaatttagtattattaaagggataaagaaaaaaatattatttaagatgtgaaaattatagtttaaaatattgttttttttaggttatgtataaaatatatagtgaaaattgtttagtgatattatatttatttatttagaaaattgtgattttaggagaatttaatatgttggtgaatatttttaatttttttttttattaattggtatttttaaaaatataatataaattttttgaagtttttaataaataatttataattgaagtgtataatataaaaaattttaaaaatttaagtagtttattgtttttttgaaagtgtgtgtagttttatttttttaaggaattattaagaatattttttaaaatttaaaaggatggtaagttgtattagaaagttttattttgagatgtaaaaagatttttaaacgtggttatattagttatttatgtatgttagaagtgtagaattggggtatttaatggttattttgtaatagttttgtgtaatttttagtgatgttgtatatatatttgaagggttttttttaaagaaatattaagtatgttttgttgtttagtgtttttgtgaattgtttggttgtaattaaattttgagtttgatattgatatggttttaagaagtagttgtattaagtgaaattattttggagattataataaatatatatatttaatttgagttgtatatttttagtttgggaaaatttgtgggggtttttttgttgttttaggttattatttatatttttttatatatttttttaaaatttattgtgaaataattttaaagaaatattgtaagaaaagtataaatttttgtatatatttagtagagaatgatattttatttaaagtttttagtttgtatgggtgatggaggagatagtattatgtttagtttgtgatatataaaggatttaaataattattattaaaatgagtatattttaaattttgtagtttttttaattgttatttttatttttatttttttattttttatttttgagatagagttttgttttgttatttagattagagtgtattggtataattttagtttattgtaatttttattttttaggtttaagtaatttttatgttttagttttttgattagttgagattataggcgtgtattattatgtttagttaaattttgtgtttttaggagagatatgttatgttatgttggttatggttggttttaaatttttggttttaagtagtttgtttattttagttttttaaaatgttaggattgtaggtatgagttattatgttcggttatttttatatttttaaatgtaaattttgtttattttttgagtgagttatatatttgtattagttagttaaggttgttataaaatattatagatgggtggtttaaataatagatatttatttttttatagttgtggaggttggtagtttaagattaaggtgttagtagggttggttttttttgagttttttttttttgatttgtagatggtttttttttttttgtgtttttagatagttttttttttaggtgagtatatttttgatgtttttttttttttataaggatattagttatattggattagggttttatttttatgattttatttaattttaattatttttttaaaggttttttttttaaatatagttataatgagggttagggttttaataaatgaattttgggggtaagtgttttttttattgttgagtttgatttatttttaaaatagtaattaagaaaaatgaattttagtattgtttagttatttattttatatttatttgtaaaatttaatagttatgtaatgtaaagattattttttgttttttgttataggatatttgttttagattatttagagaattttaaattttttatataggaaagttttgattgtttaattggttattattaaattttattattttaaaaggatataatagataagaaggtaattttaatattatattgtaatttttgagataatttaatcgattagattaagtgtgttagaaaagatagatttgtaggattattaaaatggtattttaggttaggtatagtggtttatatttgtaattttaatattttgggaggttaaggtagtggattatttgaggttaagagttcgagattaggatggttaatatggtgaaattttgtttttattaaaaatataaaaattggttaggcgtggtggtttatatttgtaattttagtattttgggaggttgaggagggtagattacgaggttaggagtttaagattagtttggttaacgtaatgaaattttatttttattaaaaatataaaaattagataggtatggtggcgggtgtttgtagtttagttatttgggaggttgagtgaggtaggagaatcgtttaaattcgggaggcgggggttgtagtgagtcgagatcgtgcgattgaattttagtttgggcgatatagcgagattgttttaaaaaaaataaaaaataaatataaatattaattaggtatggtgtcgtgtgtttagttatttaggaggttgaggtaggagaattatttgaatttaggaggcggaggttgtagtgagttaagatcggttattgaattttagtttgggcgatagagggagatttcgtcggaaaaaagaaaaaaatggtattttgtgcggttataaaaaagaatgaatttatgtttatattttttgaattaatagaatgaaggtaaagattattgttttaagtgaattaatttagaaatagaaaattaaatattgtatgtttttatttataaatgagagttatataatgggtatatatggttataaagatggaattgatgttggggattttaaaagtggggaggtgggggagagtaagggttgaaaaataatttattgggtattatgtttattatttgggtattgggtatattagaaatttaatttttattagtatgtaatatatttatgtaataaatatacgtatttttcgaatttaaaataaaatgatgaaataaaaaataaaatggtattttgattaagggattatagaatttaagagtttttttttaaattatagttagttttttttataagtttttttttaggggtatgaatataaaagggatatggaaaaattaaggtatagtaatatttattgttagttatttatatggttttaaatgttaatgtagaaaaatttttattatataaatatttagtttttttaaagtatttgtattagttttagaataaattatgtttggttttttttaatattgtttttattttatgtttttttttcgttatatttaagtttgaatttaagatgttgtaattatgattttaagattgttatttagatatatgagaaatagaatttaaaaaaataagacgtttataataagagagagtatttggttttattgtttattgtggggtttttttgggttatagttggtgttttagttttaaattggaagtattttggtagaaaggaagagagaaagatagttgggtttttggtttttttattaatatttttattatttaattatttatttattttttttattttgttaggttattaattttattttttattatggaagagaaggatagaagagaatattagttattttttttaagaacgtttaattatagtaattttatatattaaaatttgaataattaggtaagtattttttttttttgagaaggggtgaaataggatttaatataaaggaggagtaaaaagaattttaagaataatgaataagaatttaaggtaatagttttgtaatagggtaagagtatagtgaaattatattgaggtaggagggaagtttttgtgatgtttttatggtaagaaagaaggaaagagagaaagagagaaagaaagagagagagagaaagagagaaagagaaagggaaagaaagagagaaagaaagagaaaataaagaaggaaagaaaggaaggaaggaaagaaagaaaagaaagaaaggaaggaaggaaggaaagaaagagaaaagaaagaaaggaaagaaaaaagaaagaaaggaaggaaggaaggaaagaaagagaaagaaagaaaagaaagaaaggaagaaaaattaagaaagaaagaaaagaaagaaagaaagaaaaagaaagaagaaaagaaagaaagaaagaaagaaagaaagaaagaaagaaagaaagaaagaaagaaagaaagaaagaaagaaaaagaaaggttaggtatagtggtttacgtttgtaattttagtattttggaaggtcgaggtaggcggattatttgaggttaggagtttaaaattagtttaattaatatggagaaattttgtttttattaaaaatgtaaaattagttaggcgtggtggcgtatgtttgtaattttagttattcgggaggttgaggtaagagaattgtttgaatttcggaggcggaggttgcggtgagttgagattatgttattgtattttagtttgggtagcgagcgaaattttattttaaaaaaaaaataaaaaaataaagaaaaaagaaaaagaaggaaaagtaatagattatttgatgtttggtaaaattaaagggagtgttatagttttattagaaaaattagtaaaaatatatataggaaattaatgaatttaaaaaaggtaattattgattttatgaaaaataaagagaggtggaaaaaaggtaaaataaatataatatataaggtgaattaaattatgtgtaataagtatatttatattaaataatgaatatatagttaggtatagcggtttatatttgtaattttaaagttttgggaggttgagataggattgtttgtataaattttttttgtgtagttataaaaaagaatgaaattatgttttttgtagtagtataaatggaattagagattattgttttaagtgaattaatttagaaatagaaaattaaatattatatggttttatttgtagagtttaagatttgtttgggtaatatagtgagagattttgtttttataaaaaaaaaaaaaaaaaaaaaaaaaaattatgaaaaattagttaggtatgggggtatgtgtttgtagttttagttattcgggagattgaggtaggtagattttttgagttatgaatttgaggttatagtgagttaagatggtgttattggatattagtttgggtaataaattaagattttgtttttaaaatttaataataattattattattattataaatatagattgaaatttaaattataattatattgagaatgaagaaagaagtagtaaatatattggggaaatataagagatttaagttatagttatatttattagtatattagtatttaatgttttaaatttttaaaaatgaagaaatagtagtgaaattataataatatatttttatattttaaatatgtttgtaaaatatgtaaagtatgaaaatattaagtatgttttaaaaaatatattgtttttgggaatataaaattgatataattattttgaaaagtgaattaaagtttaggatgtatatgttattaatgaaaatagtaattgtcgagattgaaatatattaattatattttaatgtattattttatgatacgataaaataaaatattttattggttatttttggaggagtttagggag

SEQ ID NO: 53 - DNA, 24238 bp, Artificial Sequence
  bisulfite converted genomic DNA
ctccctaaactcctccaaaaataaccaataaaatattttattttatcgtatcataaaataatacattaaaatataattaatatatttcaatctcgacaattactattttcattaataacatatacatcctaaactttaattcacttttcaaaataattatatcaattttatattcccaaaaacaatatattttttaaaacatacttaatattttcatactttacatattttacaaacatatttaaaatataaaaatatattattataatttcactactatttcttcatttttaaaaatttaaaacattaaatactaatatactaataaatataactataacttaaatctcttatatttccccaatatatttactacttctttcttcattctcaatataattataatttaaatttcaatctatatttataataataataataattattattaaattttaaaaacaaaatcttaatttattacccaaactaatatccaataacaccatcttaactcactataacctcaaattcataactcaaaaaatctacctacctcaatctcccgaataactaaaactacaaacacatacccccatacctaactaatttttcataatttttttttttttttttttttttttttataaaaacaaaatctctcactatattacccaaacaaatcttaaactctacaaataaaaccatataatatttaattttctatttctaaattaattcacttaaaacaataatctctaattccatttatactactacaaaaaacataatttcattcttttttataactacacaaaaaaaatttatacaaacaatcctatctcaacctcccaaaactttaaaattacaaatataaaccgctatacctaactatatattcattatttaatataaatatacttattacacataatttaattcaccttatatattatatttattttaccttttttccacctctctttatttttcataaaatcaataattaccttttttaaattcattaatttcctatatatatttttactaatttttctaataaaactataacactccctttaattttaccaaacatcaaataatctattacttttccttctttttcttttttctttatttttttattttttttttaaaataaaatttcgctcgctacccaaactaaaatacaataacataatctcaactcaccgcaacctccgcctccgaaattcaaacaattctcttacctcaacctcccgaataactaaaattacaaacatacgccaccacgcctaactaattttacatttttaataaaaacaaaatttctccatattaattaaactaattttaaactcctaacctcaaataatccgcctacctcgaccttccaaaatactaaaattacaaacgtaaaccactatacctaacctttctttttctttctttctttctttctttctttctttctttctttctttctttctttctttctttctttctttcttttcttctttctttttctttctttctttcttttctttctttcttaatttttcttcctttctttcttttctttctttctctttctttccttccttccttcctttctttcttttttctttcctttctttcttttctctttctttccttccttccttcctttctttcttttctttctttccttccttcctttctttccttctttattttctctttctttctctctttctttccctttctctttctctctttctctctctctctttctttctctctttctctctttccttctttcttaccataaaaacatcacaaaaacttccctcctacctcaatataatttcactatactcttaccctattacaaaactattaccttaaattcttattcattattcttaaaattctttttactcctcctttatattaaatcctatttcaccccttctcaaaaaaaaaaaatacttacctaattattcaaattttaatatataaaattactataattaaacgttcttaaaaaaaataactaatattctcttctatccttctcttccataataaaaaataaaattaataacctaacaaaataaaaaaaataaataaataattaaataataaaaatattaataaaaaaaccaaaaacccaactatctttctctcttcctttctaccaaaatacttccaatttaaaactaaaacaccaactataacccaaaaaaaccccacaataaacaataaaaccaaatactctctcttattataaacgtcttatttttttaaattctatttctcatatatctaaataacaatcttaaaatcataattacaacatcttaaattcaaacttaaatataacgaaaaaaaaacataaaataaaaacaatattaaaaaaaaccaaacataatttattctaaaactaatacaaatactttaaaaaaactaaatatttatataataaaaatttttctacattaacatttaaaaccatataaataactaacaataaatattactataccttaatttttccatatcccttttatattcatacccctaaaaaaaaacttataaaaaaaactaactataatttaaaaaaaaactcttaaattctataatcccttaatcaaaataccattttattttttatttcatcattttattttaaattcgaaaaatacgtatatttattacataaatatattacatactaataaaaattaaatttctaatatacccaatacccaaataataaacataatacccaataaattatttttcaacccttactctcccccacctccccacttttaaaatccccaacatcaattccatctttataaccatatatacccattatataactctcatttataaataaaaacatacaatatttaattttctatttctaaattaattcacttaaaacaataatctttaccttcattctattaattcaaaaaatataaacataaattcattcttttttataaccgcacaaaataccatttttttcttttttccgacgaaatctccctctatcgcccaaactaaaattcaataaccgatcttaactcactacaacctccgcctcctaaattcaaataattctcctacctcaacctcctaaataactaaacacacgacaccatacctaattaatatttatatttattttttattttttttaaaacaatctcgctatatcgcccaaactaaaattcaatcgcacgatctcgactcactacaacccccgcctcccgaatttaaacgattctcctacctcactcaacctcccaaataactaaactacaaacacccgccaccatacctatctaatttttatatttttaataaaaataaaatttcattacgttaaccaaactaatcttaaactcctaacctcgtaatctaccctcctcaacctcccaaaatactaaaattacaaatataaaccaccacgcctaaccaatttttatatttttaataaaaacaaaatttcaccatattaaccatcctaatctcgaactcttaacctcaaataatccactaccttaacctcccaaaatattaaaattacaaatataaaccactatacctaacctaaaataccattttaataatcctacaaatctatcttttctaacacacttaatctaatcgattaaattatctcaaaaattacaatataatattaaaattaccttcttatctattatatccttttaaaataataaaatttaataataaccaattaaacaatcaaaactttcctatataaaaaatttaaaattctctaaataatctaaaacaaatatcctataacaaaaaacaaaaaataatctttacattacataactattaaattttacaaataaatataaaataaataactaaacaatactaaaattcatttttcttaattactattttaaaaataaatcaaactcaacaataaaaaaaacacttacccccaaaattcatttattaaaaccctaaccctcattataactatatttaaaaaaaaaacctttaaaaaaataattaaaattaaataaaatcataaaaataaaaccctaatccaatataactaatatccttataaaaaaaaaaaaacatcaaaaatatactcacctaaaaaaaaaactatctaaaaacacaaaaaaaaaaaaaccatctacaaatcaaaaaaaaaaaactcaaaaaaaaccaaccctactaacaccttaatcttaaactaccaacctccacaactataaaaaaataaatatctattatttaaaccacccatctataatattttataacaaccttaactaactaatacaaatatataactcactcaaaaaataaacaaaatttacatttaaaaatataaaaataaccgaacataataactcatacctacaatcctaacattttaaaaaactaaaataaacaaactacttaaaaccaaaaatttaaaaccaaccataaccaacataacataacatatctctcctaaaaacacaaaatttaactaaacataataatacacgcctataatctcaactaatcaaaaaactaaaacataaaaattacttaaacctaaaaaataaaaattacaataaactaaaattataccaatacactctaatctaaataacaaaacaaaactctatctcaaaaataaaaaataaaaaaataaaaataaaaataacaattaaaaaaactacaaaatttaaaatatactcattttaataataattatttaaatcctttatatatcacaaactaaacataatactatctcctccatcacccatacaaactaaaaactttaaataaaatatcattctctactaaatatatacaaaaatttatacttttcttacaatatttctttaaaattatttcacaataaattttaaaaaaatatataaaaaaatataaataataacctaaaacaacaaaaaaacccccacaaattttcccaaactaaaaatatacaactcaaattaaatatatatatttattataatctccaaaataatttcacttaatacaactacttcttaaaaccatatcaatatcaaactcaaaatttaattacaaccaaacaattcacaaaaacactaaacaacaaaacatacttaatatttctttaaaaaaaacccttcaaatatatatacaacatcactaaaaattacacaaaactattacaaaataaccattaaataccccaattctacacttctaacatacataaataactaatataaccacgtttaaaaatctttttacatctcaaaataaaactttctaatacaacttaccatccttttaaattttaaaaaatattcttaataattccttaaaaaaataaaactacacacactttcaaaaaaacaataaactacttaaatttttaaaattttttatattatacacttcaattataaattatttattaaaaacttcaaaaaatttatattatatttttaaaaataccaattaataaaaaaaaaaattaaaaatattcaccaacatattaaattctcctaaaatcacaattttctaaataaataaatataatatcactaaacaattttcactatatattttatacataacctaaaaaaaacaatattttaaactataattttcacatcttaaataatatttttttctttatccctttaataatactaaattctttctcttaaaaatttatatctattttataaatatcaatcttactataaattttcaactttaactcgaacttatttataaaaaatatctaacatctacaacttcaactaattatactaaaaaaaaaaaaattacgataattttattataccttatattaacaataaaccttctcacaaaaaaaaaaatactttaaataccttaaatcgtatatacaacaataaaaattcacatttcatactttaataaaacacttaaatcatccataaaacaatcctcataatttattaaaataaaacctttctaatatctaaacctctactatataccaaatacgacaaaactctaaatattataacaacaaccaaacttctaccatcctcctatctaataaaaaaacgaaaaataaatcttcgcaaccatcaaattataaccacaatcctctatcataataaaataacatccgacgtactacaaacctcaaaacccacgtaaatcaacttaattatttaaaaaatactcaaaaaccaaaatattctctaatataaattataaaataataataacccttctaaacacaactaaatataacatatatatatctattacacaaaattttataaaaatccaaaaacaatactatatttctttccttacctattatatacatttttctaataaattcaatatttcactaaaaaatataacttacaaaaaactccccttaaaaacaaacccaaccctaccgctcccaccaacctcatccaccaataaaacactctctaaatcctaaccctataaaaaatctaaaatctctaatattcgcaaaatcctcaataaaataatatcttcctaaaccaaacccataccaaacacacctaaaaacaaattcctacctccaaaaccattttcactaaaatctaacaataaaaaatctaacaaaaaaatctaaaatatactactaatctccttcaactcccgaaaaataaaaaaacgaaaataacctaacataacaaaaaatatcctttaactatctaaacaatactatccgaaacgctccctacgaaacccgccaatacgacaaaaaaaacatttaatcttctctattactttactaaacactatctttctcaaaaaaatatatatccaaaaatctaaaataaaattcacaaaaacaattcgaataacctacaaatctaaatttttactaacttctcgctccaaacttaactaatataactaattaacgaatactcgcacctacataaataaaatcgcacatttaaatttcatcattaatcaattaaaaaaacatataaatactatatctaccttatcaatattaaaaaactaccttcatttctaataacaaattccaaaaaaaaaaaaaactacataataaacctcaaaaaaaccaatcataaactaaacacgataactcacgcctataatcccaacactttaaaaaaccgaaataaaaaaatcacttaaaatcaaaaatccgaaaccaacttatccaacataacgaaaccccatctctactaaaaatacaaacattaaactaaatacgataactcacgcctataatcccaacattttaataaaccgaaataaacgaatcactaaatcaaaaaattaaaaacctcctaaccaacataataaaaccccatctctactaaaaatacaaaaattaactaaatataataacatacgcctataatcccaactactcgaaaaactaaaacaaaaaaatcatttaaacctaaaaaacgaaaattacaataaactaaaatcccaccactacactccaacctaacgacaaaacgaaactccgtctcaaaaaaacaaaaattaaccaaatataacgacacacgcctataatcccaactactcaaaaaaataaaacaaaaaaataacttaaatacgacgaataaaaattacaataaactaaaataataccactacactccaaccaaaacaacaaaacaaaaatctatttaaaaataaaaaataaaaaaataaaaaccaatcactacaaaaatacaattacatattctaaattcgtataactttaatatttttataactatcttataattatcttccctaaaacaaaaacaatatacaaaaatacaatataaatacaaatcacatatatataaaatattcttaaaaaacactttattaacttcatttctataaatacttttaaatttttataattctaataaaataacttttttcccccaaaaactactaatttcttattccaactatcattttacataatttaaaaaaaactcattttataaatcaattaaccatctaatcaccaaaataaaaccaaaattcttttattctaatctaaaaaaaatatactaaaaaattttacaccaacaacaaaatctcctattacccaaaataaccaaaaaataatttttattttctctataactctattccccaattataataatcacaacgaataaataaaaatttactaaatttaaaaaaaaaaacatcacatttcaaataaaaataactccatatacaaaatcataaaaaaataaaataatatatcaacatctaaaaacttcaaataattcaacgaataaaacataaatttatataaacttacataatcattttaatccttaaaaaaaaatacatttattaaatatacatatatatatatttttaaaacaaaatctcactctatcgcccaaactaaaatacaataatataatcattactcactacaaccttaaccccctaaactccaacaatcctcctactataacctcctaaataactaaaactacaaatatataccatcatacctaactaactattattatttttataaaaataaaatctttctatattacccaaactaatctctaactcttaaactcaaataatctacccgctacaatctcccaaaatactaaaattacaaaaataaaccaccatattcaacctcaaatttactcttaaaatattataatttttttttacctaaatattacttctaattccactaaaatcatttatataaaaatctcatctataattaatataaaaataataataataataattcacataaaaataaaaataaaaataataatataaaaataaaaataattaccatatatcttaaataattatttaataattatttcttacctttaataattattttaaattaaaaaaaaaaaattaaatctcacaatcaaaaaaaatacataaaaaccacaaaaaaaaaaaaaaactaacaaaaacataactaaaaccatttaactaaaaacaaatatctctaacaaaacttaaaaatattactaccttactatatacaacgtaacaataaataactcataatatataaatcacctaaaacaaaaacaatttaattaaaactaaatcaattcacaacgaaaaaaacgattcattaaccatttacatatattcctttaacacttactaaatataacaatatttaaatcaaaatattataaaaaaattttcaacaatttaaataaaatttaaataaaaaaaaaaaaaattatttttttcttcctttaaaaattctttaaatctttaaaatattcgaaaaaatacatttcattaatctacaaaatcaaacttatattaaacttactcctaaataatactaaatcaataaaataaaactacatttctttttcttccttaactaaaatttaaatcttaattaactataaatctctaatcctctctcaaaaaatttttattcatttcctttattattattttattattattcacttattttattttaaaaacttacactcattacaaaatctaacctaaacttattttaacaacaaaactaaactaaacaaactataaaaccatttaattcaatttattccacttaaaataaatattcctatattctaatccaaaattactattccaattctaataaaaatattacatattttacaatatattattaattacttttctaaaaaccaaaaaattctaaattctaaaactcatctacccgtaaatattttaaatataaaattataaacctataaatctcaaaaaataaaataataacatacctctaaccaaaataaaattaatatcttcctatataaaaaacaactaaatcaaaaataaactaaaataaacaacaatatataatatcgcctcttaaaatacttttaaaaactacgctaaaataaataataatatcaaaacaaaacatacttaatttaaaaaaaaatctttacaaaaaataaaataaaacatcttaatttcttccttccataaactttaaaatcttcaactatacctaaaaactcaacaattccctcaactctacaaaccttttctcaaataaaatatttattactaaaacccaaaaattttaaaaaacttaaaatatcccccaccctattaataacaaaatctaatctaaacctccatattaccttttctattctaccaatctaactttctatttaattattatttcctaacaataaaattattaataaaaaacataaaatctatattttattcacatcacatactacgttcctaaaaataaaaaaaataataacgttaaatctattaatatcaaatcctatatataatctctaaaaaaaacctacgaccgaatttatacgaacttaaaccttcaaacctccaaataacaatattactccacttaaaaatttctaatactacctccctaacaaacactatataaaaccatctccgaaactcgcaaaacaaaattttaattaaatctaaacctaacgtttctaaaatttttaacactaaaaatattttattactaattacttctcctaccacaacctcaaaaaaaacataactactactaaaaaaaaaaaaatttttaaataattaaaataaaatttataaccattcaaaaaaatacattaaaaattaacattttaaaatttctataaccttttaaaaaaattaaaatattataaaacaattaataataaattttcataatcaaaaataataaaaaacaaaaaaaaaatcatttctatacctcatctcatccacaacaacaataaatttcgactaatataaaaaaaaataaaaaaaaactatattaaaaatatactctattttaaaattttccataaaaaaaaaaaaatttacaattaatacaaaccactaaacctaatcattcaatatcttttcaataaaaaaaaattcacaaaataataaaaatataaatttaaaaaacaaaaatccaaattcaaataaaaacatcctcaaaaattaattaaattaaaaaaaatcaatataaattttactttacaacgtatttcaattaaaacttacttcaaataaaaaaaaaaaaaaaacaaaacaaacaaaaactccacgcatcttacaatatttaaaaacataaaacaacctctacttcactttaaataaactacttaatttactatttccaaaaaaacaaaaacaaccccaattaaaataaaaacatccgaaataatacttcaatatctcgtaaaaaaataaaaacacttttcgaaattcttatccaacaaaccctatattttacataattaaacaaattcaaacaattttcaatattaaaaaaatatattactaataaaactaaacctccgaatcaaaaaaaaatataaccgaacataataactcatacctataatcccaacactttaaaaaactaaaacaaacgaatcacctaaaatcaaaaatttaaaaccaacctaactaacataaaaaaacccaatctctaccaaaaatacaaaattaaccgaacgtaataatacatacctataatcccaactacttaaaaaactaaaacaaaaaaatcacttaaacccgaaaaataaaaattacgataaactaaaattacgccattacactccaacctaaaccacaaaataaaactccgtctcaaaacaaaaacaaaaacaaaaacaaaaacaaaaaaactcactaaatacaaacaacgtatctcctttcttccaattttaaatctttttctaataactcctactatatacatataatttattattaatattaacatattacaatattctaaattattttattttcttttaaaaaaaatctcactctatcacccaaactaaaatactataatacaaacataactcattacaacctcaacctcctaaactcaaacaatcctccaacctcaaccttccaaattactaaaaccacaaacacatattaccacacccacctaattttttttaaattatattattcacacttttttttaaaataattaaaaattaaaactcaaaaacaataaaacataactttaaaaaaatacaataaattcaaaaaaaaatataataacaaaaaaactataaaaaaactatatactataaaaataaatacccaaactttaaaaacaaacaaacctctattcaaatcctaactctacccttataacgtatatacaaattattaaaatacttaatacaatacctatcgtataacaaatatattaactctcattactttttctttcaacccatatataaaaacttacccaatataaaaaatatcaataatttaaaaactataacttaaaaataactttaaaatataattaataatataatatcaaaaacatatacttcctacttaataatttatttacaaaaaatattaaaaaaaaaatattaaactcttaattaaatttaataataaactatcaaaacaataacgctttccaataaataacaaaatctataactaaatttaaatatatatactacttattctattccaaacacataaaaaaaattatctatataaactcaattatcccactaccttattaaaaatccaaaattaacacaactattactaaaaattcttatcactttctttttttcaaataaaaaataataaaaataattattaactaaataatatataaaaaaacttaattcttcttctaaccatttataaaaaacaaattaaatctctacaaactttataaatcaacctctacactaaaaatttctatttttttttatttatttatttttaaaactctcacattaaatattctaataaaaaactacaaaaatcacgtcaaaactaaaaaaaaaaatcttattaaaaaatattcaatacaaacaaattaacaaatcaaaaaaacataataaaataaacattaaacgaaaactcacctataactaccctataaattacaaaataatataaattcttcatttacaacttaaaaaactaaaatataaaaaaaataaaaatactaatcaaccctactttctccttaaaacttttcaaaattcaaataaaataccaaatataaaaataacttacttttatattactcaataatcttcaaattactactactaaatctacaattacatattataatttaaaacttccttctaaacattacaattttttaaacttaaccaaatttatttaaacaaatccaatcttttaaattctatcataatcatacccaaatttataacatttctcttatatatataaatatacttcacactcatctaacatcccatcaattattttataactccacttccaatttacctacaataaacaaaaacatatctatttacaaaatttttatctatccttataaacttttactaatcaaatactaataaaaactttataaaaacaactaatttataataaaaaaccaaataaacaatcacaaaaaatattttcctaaaaacctaaattttacctcaccaaaacaaaaaattaatcaaattaactattctacccctaactaaaataaatatttattacttcaaaattaaaaaataaaaaaaacaaataaacaataaatacaatcttaaattacttatatataaaaaaaaataaccttcgaaaccctataataactatttaaccctaaaacaaaatatttaattataataatcatcttaatattcattaataactacaaaattaaacactaataattcatcaaactacaacatttaaaaccaaaaccttaaaaaactatcttacttacatatttctaaaaaattcaatccttttcgtttatcttaaatataaactctcacttcttattctcacaaaattttaaaaattctcacttccaaaattctcctatatttaaaaaaactataaaactaattataaataaaaaaataaacaaaataacaaaaaccacctacccactaaatcttatcatataatattccttataaatcatacttacaccttctctaatcattaattataacccaattcaaaaaatactacaaattcaacacaattccttatatccacaactaatttcccaacctttctcaaatttccactccaatcttaactctatttataaaatatatatattttaaataacaaattaaaatttattttttatactaaactcaataccaacccccctctaaaaactataactctttcttccctaatatccaaaaaacaaaaccttaactacttttcaataactacttattttccttaaatattatatcaaactttctaaaattccaaataaactacatttactttattaacctttccaaaacatttaaaataattccaacgctttaattttccttaaataaaattaacaaccacttaatttaataaaattaaatacttcattaatttctttaaaactaaaaataaactcaactactttcaatatcaaaaaattctaaactttaatcttaatttacaacataaatataaaaacataaaaaaaaaaaattataaaaaaaaaccaaaaaaaactatatttacgaaaaaatttttaattatttcaataattactaaattataaaaaaaaaaataaataaataacataataaacccatcatttatcactaatttataattaaactaattctaaaattaaactttaataaccaaaactaaaaacgacaaactaataccactactattttaaaattccttatttctcacaaaactatataaatacttaactaataaaattacttcttaattaaactaatttcaattttcaaatcaaaattacttaaaatttactacacgttactaacattatacaaataaacaatatttcttattaattaaaatataattaatctacaaaccacaaatacaactcctataatttcttacctctaaatcctcaaataatttcaaaactttatataaaaaccctaaatcttaaatccaaatctaccacttcaacctataaaataaattaaaccttatatatctctctaaatattaaaaaaaaataattcatccgtaactatacaaaaatccataactttacatacttacttccaaccaaaacacatttataaaatatatacatattactaaccttctaactctaattcctctatccctttaaataaatattctaaaaataacaaccattcactttatcatttactattctataaaacacaaaacaaaaacccaaaaacaaaaaccccatcaaaaacaatattatttcttccaaaatctcactttattctaaattaccattacaaacaataaaatatatttatataactcaaatataacttaactctataaattatattaaatcctaaaataacttaaaaactcttataacctattatatttacttctatttatacaaattaataaaaacctactatattctaactctaaaccccctctaaattccttccatttacaatcacttttatcaaaaatatatttttacaccaaaaatccctaaacaatatcaataaaaaaaaaaaaaaaataataacccattacattttatattctcttattcccaacaaacataaaaaaaaacaattatctctttttaaattaataatttaaaatttccaaaaatacaatattttaaaaaataaaaaaactcataactaattactttcaaaaaaaactctaaataaaatattacattattctacccatctacttctaatacattccattttaaccacaaacaaaataaaaaactaaataaaatttaaacctttctatttatcatattttaaaaattaatccaaaaacaattcttaaaaaataaactaaaaataaaatataccaaaactccaacccacgctttacaaacgccaaaataaaaaatattctacgaaaaaaacgtaatataataacacataaactaaatctaacctcaaacgacctaaaatccattacaaactataaaactttaacttaaaaaaacaaaaacaaccatctctaaacctcgatttctctaaaataatactatacctcgcacaattatcgaaaattcaaatcccataccctatatatatcaacctatccataattaatcaccctaaaaaactttactttcctaatctaaacaaaataaaaaaaactaaatctaaaccctaccctatatataaattaaaatttatatactttaaactaccctcccaaaacacaccataataaaaaacaaaaaacctaacttaactatataaattcgactaaattattttaaacgtatcattcactccctcaataaaataaaaaaattaaactaaaacacctcttaatatctcttctaactttaaaattctacgcaatccacgaaaaaaaaaattcaaaaaaccttacatacatcaaaacaccaaaaaccccactttccttaaaaataatttacaacgaacaaatcaccatccctaacatttcaaattttacaattcacaattcacaatacgaaaaaataaactaaatcacactacaacaaactcccctccacgtctaacaaaaaaaacgaaaaattttcttaaaaaactcgaccaatatcaaacaacaaaaaataaaaactatctcgataaaaaaaaaaacccaaacttccgaaaacataaactaaaaaatataaaaacaaaacacctactaaatctcgttaaaattaaaacttcaaaaaaaattaaacctactctaaaaaacaatataaaaatcccaaccccgacctaaaaacgacacgttcactaccaaaaactcaaaaaaaaaacaaaaaacgaaaaataaacgcgaaaaataaatacgaaaaaaaaaccgaataaaaccccaaccccgatcactcaccacgaacgaaataaaacaaataaacaccaccaaaaaaataacaataaataaaataaccatctaaatctcgacgcccgcgatacgacgaaaactccgacgacgccgaaaatcgctaaaacgcgacaaaactaaaaaaacaacgaaataaccccgaaaaacaaccgaaacgaccgcgaccgcgtaatactactcgatacccaacgaaatacgacgcataaactaacgatacatacgaaacaacgcgccgcacacaaacacgttacaaaaaacgataacgaaaataaaaaaaaaactaaaacccgcgtacatataaaaataaacgacgtacgccgtcacgttaataatccaatcgataaaacaccaaatatctaaatactacaaccgcgaactaccgaaacccatattaaacaacgcgcaaaaaaacacgttaaacgcataaactacaaaaaacgtaaaacccgccaatcgcttatccacgtaataactataaaaataaacataattaataaccaaataacgctcgacactcataacgcaaataatactaaaaccgaacaaactaaaaaaaaacaaaataaaaatactatactcgcacaacgactaacccccgaaccattaacccttcatatacgtaacgataatcaccgaactcaccaacaaaatacccaacaaatcgataacaaccaacccacataccaacgtataaaaaatcgtctccttctactccttacgcgacttacacaacaccacgataaccaccaaattacccaccaccccgaaaataaacatcaccgccgaaataatcactaaactattcaaccgatcgaaactcaaaaaaacgaacgaattaaccccgaaaataaacataataataactaacgatacgcaaccttaaaatacaaaactaaatctaaaaataataaaaaaaaaacaaaactaccgtaaacgaaaattaccacttataaaatattaaacccgcgcccgaaaaacgatacactaataaaacaaaaaaaacaactcgatcctactttctaaattataaccacttaccaactacgaccaccaaaatctccaaactcgcgatacgtcctaccaacaacacactcttactaacattaatatttataaactaattttcccattcctcttcctccccacaatccaactcactccattaccaaaataaataaaacccatctcaaaaaaaaaataactcgctaatactattctcgataaattctaaatcaataaaatactcactaaaaacaaattacaaaaacaatttaaaaaacgcgctcttcccttcttaactctcttcgacgaaaaccgcatccctacgttctctacccgttaaccccaacgtcaacccaacgccatctcacctataacgacaacaacgataacaacctcacgaacccccaaaatcaaccctcaaatatcctaaacccgcctccaacctactttcaccttatcctactcaatctaaaaactaccaaatcttcgacttctcaaaaccgatctcaataactatcgatttttaaacaccgaaatcaaaattaccaactttcaaaaacttaaaaaacaaaaaatacaacgaaataaatcaataaaaaataatactaaatttcttactcgctattttttttccttcaaaaacgaatcccaactttacaatacccgccgatctcgtctacgaaaaaacaacgttcaaatataaaactatacgcgcaaataacgcgaaaccttaatccccaactctaactaccctccgccccaaccacgaacaacacgaacgactactaaaatttacgactaccgctaaaaccgctcctaactacctaaaaacgactcgaaatccactctaccaaaaactctaacctaaaactattcatcttcctctcgaactaccgaacttaaaactccgctctcgcctttccaccctctatacaaacttttctcctcctccaaatttccctaacgaaaacgaaaacaaaccgcgcgctacccgaacgcccattaaccgaattaaaaaaaaacgaaacgcgtcctccctaaacgccgcaaaaaaaactaacgaaaaacgatatctaaactaaaacgaaactaaacgcgcgaaataaaacgactcccgtaattttcacgccctcgaaaatacgaaataaaaactcgaaaaaaaccctaaaaaaccccgatactttccccgacgaccgcttaaccgctcctaaactcgacttccaataaaaccaccactaaaaccgacgaccgtttccgcctcgctacctaccgctcgaaatatactatttcttaaacctcctatccgcgaaccgcaacatctaaatcgtaaaaaaaaaaacaattattttaaaattctacctaaaattaaccgaaaaaaaaaaaaaaatacgatatctacgctaacgcgtacgccccgaaattaaacttaaatacgcccaacgaacgtaataaataaataaataaataaataccaaattaaacgaaaaaataacgaaaaatccatcctctcaccataaaaaaaattaaaatcaattaacaatacccaaactacgaactacgcttaatcgaacaccccaaacaaaaaaaaaaaaaaaaaaaaaaaaaaaaaaaaaaaaaaacaataattacaacctctcccgacgcaaataacaaaaccttacgactttaaaaaaaaataaaaccttaataaaattaaaaaaactacctaactacgatctttttctccattcttcctcctaaaaacttctccgccctaaaaaaataacgtaaacttcataccttcgaccgaccgtattatactcgttaaacccaattcaccataaatcctttaaaaaactaataaaaaataaaaaaaaaatttcaaaatcactaaaataaaaaaattctccaaacaccacctcataattaattcttaaaaaaacctatttacgcgacccttaaaatcattttaacttcttatctaataataaaatttttctctataatccttctactctattttctaaaaccaaaactaaaaacctaaaaaattataaaacttcataatataattaaaaccccttcaccattttttttaaataaaattatataaccttattacacaatttaaattcctaaaaaaacctcttcccatctacaatatacaaacattctaacatattatatctcctcacaaaataaataaataactaaattcttttatataataaacaaatacccatttcttaaatattatttcgtaaacgaacaaacctcctaactaattcttcaattaatctcaacaacacataaataataaaaaaaactaaaaaaactttccgatttcaaataattacaaatcataaaatatccaaaatcatatttacttacaaaaaacactatataaatatactaataaaaaattattctatttatactatttacttaataatataaaaaaaaaaaatacacatttattaaccaatattaaaattaataataattaatcattttcttaaaaatcttcttttaatcaatactctaatcacttctattatcgatacttcctttaaacaataacctctaaaattatatcaacacaaaaaacaaatcaacattaaaaaaaaaaaaactacacactctacgccattcctcactaaccacattactttactatcactcatatcaattacttatcaataaatatataaaaaaaaaattaaaaaatcccttatattcactttctactaatacaaattttttttttcaattttctttccatataaaacttataaaaaaaaaaacaattaattactatttattaatttaaaaataataaaaaatatattaaatataaaaactaaaacacactactaaaataattaataactattacaaatattaacatatcattaacaaaccaaacttattatcaattaaactatttttcttactaatcctttaaattttctttctacaataactttaaaaaaaaaaaaaataaataacctaatactcaatactaaaaaattataataaaatttatctataatctcttttattatacgattcttaaaacttaaatttaactttcaaaaataaaaattaaaaatttaaataacaaattattttattttcttaatttaaaaaactaaaacaataaaactcaatttctcttacactctaccaaaaatttacattacaaaaaaaaaaaaaaaattaccataattatataaacaattcttatcattttttttcaataaaaaaatttttattctaaacactttaaaaattctccctcgcaatttctaccacaatccctacttctctatactaaaaaaccccaattcaattatttaaaactatcattaaataactctctaaaaatttaaactactccaaaaactatttaatcaatttaattactctattataactaattatttaacgaattttttaaataaacatattaaaataaaaacccatttataaacaaaaaccgcttaaaaactaataaccacttttaattttccttaaatcaaaaaaaatataaaacaaacaaaacctaaactcaaccaacaaaaataaaataaaaaaaaaaatcatttccaaaaaaaaaacaacaaaataaatcaaatctaacctaaaccccttcctaaaccgcaactaacaaaatcttaaaacattcctaaaacactaatattcatataacaaaacctatacaaattatatttacttttctctttcataacaaaccatacaaaaactcaaaacaatataaaaaacatctatcaaatacaaataacaaaatacccttaaacacatttaccctccacaaactcttccaattaatttaataaattacaaacataacattcacctaaccctaaaataactaccttccctttttaataatacatttcaaatatataccctcttaattattttcattttctaaacataaaatttatactaaacccaatacctaaaactaacacatatcaatactataattaactccccaacatcttcatataataataaattactactataaaaactaacccctactaaataattacttcaaactactctaacaacctactctaacaattacactcctcaaaataataactttctactcttttattctactcgctccctttttttccctccaatttcaccacacgcccatataaattaaaccaataaacaaaaaaaaaaaattatttacctacaataaccttttttttttttttttttaaaacaaattctcgctctatcgcccaaactaaaatacaataatacaacttaactcactacaacctccgcctcctaaattcaaacaattctcctatctcaacctccctaataactaaaattacaaacatataccaccttacctaactaattttatatttttaataaaaataaaatttcaccatattaaccaaactaatctcgaactcctaaccttataatccacccccttcgacttcccaaaatactaaaattacaaacgtaaatcaccgctcccaaaataacccatttttaaaaatacaaataaaaaaataaaaccttactaattaaaaaatctcccctacaaaaaaaaaaaccttctaattatatttcgatttcttctcatacccaaattactatatattttaacaatataaaaaatacacaaaaactccctaacttaatcaataacaacaacatcacctataactcatattaatttatcactttccataacaatttcacacttaacgttcacatacgcttttattaacaaccctctaaaaaaattaaataaatataacaaaatctactatattacaccaaatcttatttccatttcctctaaaacacataactacgtattatttcccaaactaacttcttataattaaatacaactcatataactaaattctaaccaataaaataaaaataaaattaatatataccacttccaaactaaatccctataaaacccaatcctttatactattattcgtcctctaccaacataatacaaatcccgaatatataacaaaaccactaaataaaaaataacttaacctctaaatacctatataaacctcattccaatcccaacaaccctcactaaacaataaaataaataaaaaataatacactaaaatttaaaaaatcccttatttcaacaattaacctatactaactaatttaatataattaatataatcttccttcaataaataaaaatataaacacaaaaattctatataacttactaaaaatcacaaaaattaataaaaataactaaaatttatccaatactcaacctatataaaacatcatactaactacaacatacatacgctatcaaattctcacaacaaacctataaaaaaaatactaaacaatcaaatacccatttcacaaataaacaaatcaaaatttaattaacgaatactaaaaatatttttttttttctttttttttataacaaaatcccaatctatcccccaaactaaaatacaataaaacgatcttaactcactacaacctccacctcctaaaatccaataaacctcaacttcccaaataaaccgaaactacaaacaaataccactatacctaactaatttttatatttttttataaaaataaaattaccccatattactcaaactaatctcgaactcctaaactcaaacgatccacaaacctccacctcacaaaacgataaaattacaaaaattaaccaccacacccaacccaaatattatcaattttaaaaaactacccaacaactaaactccttttctattaataaaaatcctccattacataatattatttaaaaacaaaacctaacctaccataaaaaaaactaaataaactaaattttctccttccatcctctaccacgacttaaacatataacctttacttaacttatcaaataccactatttaaaaatttaatcttaaaaaaataacgcaaaaacgtaaaaacaatttcaaaaatcattcacaacaacaatatatctaaaatttataatatcaaaaatcctacaataataataactattaattaaaacatactaactactacttaattaaaataatataaccatacctaaatttcctactaacaaccttcctattaattctttatataattaattatctttccaataaattactttcctacttatattaaccatactcaatttctattacttacaaataataaacctacctaaaacaaaaaaattaaataaactctctaaaatcacaattctaataaataacaaaacaaaaattttaatctaaatctctttaatccccaaacctatacccctaacctctatatatct

SEQ ID NO: 54 - DNA, 24238 bp, Artificial Sequence
  bisulfite converted genomic DNA
aaatacataaaaattaaaaatacaaatttaaaaatcaaaaaaacctaaattaaaatctttactctaccatttatcaaaactataatcttaaaaaatttactcaatttctctatcctaaataaacttattatttacaaacaacaaaaactaaacataattaatataaacaaaaaaataatttattaaaaaaacaaccaattacacaaaaaatcaacaaaaaaactaccaacaaaaaattcaaacataatcacaccatcctaaccaaataataattaacatacctcaaccaacaaccattatcactacaaaacccttaacaccacaaaccccaaacatactactactataaataacttctaaaattactcttacgtctttacgccactccttcaaaattaaatttctaaacaataatatctaataaatcaaacaaaaatcatatactcaaaccgtaacaaaaaataaaaaaaaaaaatccaacccatttaacttctctcataacaaactaaatcttacctccaaataatattatacaataaaaaattcttactaataaaaaaaaaattcaactactaaacaacctttcaaaactaacaacacctaaactaaatataataactaacccctataatcccatcgctttataaaataaaaacttataaatcgcctaaacccaaaaattcgaaaccaacctaaacaacataaaataactccatctccacaaaaaaatacaaaaattaaccaaacataataacacctacctataatcccgacttacttaaaaaactaaaattcactaaaccccaaaaaataaaaattacaataaaccaaaatcgccccactacactccaatctaaaaaacaaattaaaaccctaccacaaaaaaaaaaaaaaaaaaaaacactcccaacattcgttaaccaaactttaatttactcatctataaaataaacatctaactacctaataccttcctcataaatttactataaaaatttaacaacgtatacatattacaattaacataatatctcacataaactaaacattaaataaatttcaactattcttactaattcttataactctcaacaaaccacataaaatctctatacccacattctcactcactaaaaaaaaattacatcaaccatactaaattaatcaacataaactaactactaaaacaaaaaacccctcaaatctcaatacattatttctcattcacttcattatccaataaaaattactaaaattaaaataaaatccatacaaacactcaaaaaccaaatcaccttctatctaataactctaccatatacccgaaacctatattatattaacaaaaaacgaacaataacacaaaaaactaaattttataaaaacccaacctaaaaataacatatatcaattctacctctattccattaaccaaaattcaatcacataaactacacctaaccacaaaaaatcaatttaaaaaataatacgcaactatatattccaaaaaaaataaaaacaaaatttaatacaacacaacaaactctatcacacctacctaacctcctcaaaaaattactaataaaaacgcatataaacgccaaatataaaactactataaaaaataataaactaacataaactacaaataatactactactattaattaaaccaaaaaatttctatacatcctccacattactaaaacatacaacaatttaaatataaaaaaaaaccgaaatataatcaaaaaatccttcctcctataaaaaaaactctttaactaataaaactttatttctccacttatatcttcaaaaataaaccactctaaaaacgataactcacgcctataatcccaacactttaaaaaaccgaaaaaaataaatcacaaaatcaaaaattcgaaaccaacctaaccaatataataaaaccccatctctactaaaaatacaaaattaaccaaacaaaataacacatacctataatctcaactactaaaaaaactaaaacaaaaaaattacttaaatccaaaaaacgaaaattacaataaaccaaattacaccactacactccaacctaaacgacaaaacgaaaatctatctcaaaaaaaaaaaaaaaaaaaaccactacaaataaataatctcctttctttacccattaatccaatccacataaacgtataataaaactaaaaaaaaaaaaaaaaaacgaacaaaataaaaaaacaaaaaactattactttaaaaaatataattatcaaaacaaactatcaaaacaacctaaaacaatcactcaataaaaaccaacctccacaacaataatttatcaccacataaaaatattaaaaaattaatcacaacactaacatatatcaactccaaacattaaactcaacataaacttcatacttaaaaaataaaaataattaaaaaaacacacatttaaaatataccactaaaaaaaaaaaacaatcatcttaaaatcaaataaataccatatttataatccactaaaccaactaaaaaaacctataaaaaacaaatatatccaaaaatactttactatttatacctaataaatacctttcacactattttaaatctctacataacctatcataaaaaaaaaaaacaaacacaatttacacaaactttactacataaatattaatacttcaaaaatactctaaaatcctaccaactacgactcaaaaaaaaatccaaaccaaatctaactcatcctactaccttcctcctaaaaataatcccctttctcaccccactcctactaactaaacccaaatcctatctatcccatatttcctttaatccaaaaaaaactaaaaataattactaactcccaaacgacctttatttataaataaattcccaccttaatatatttactcaaaaaactcgtcaaataattaactataacaaaacaatcaaactaatcaaacaattcttaaaataattcaaaccttcaaaaaattatttaataacaattttaaataactaaactaaaatcttccaacataaaaaaataaaaattataacaaaaactacgaaaaaaaatttttaaaatacttaaaataaaaatcttttcattaaaaaaaaataacaaaaattacccacataattataacaatttttcctttccttttacaatacaaattcctaacaaaatataaaaaaaactaaactccactatcccaatttttcaaactaaaaaaataaaataatttactacctaaactttcaacttctacttttaaaaactaaatttaaattttaaaaatcgtacaacaaaaaaaactacaaataaacctcattacaattttttaatattaaacattaaattatttattttccttcttcctaaaactactataaaaaaaaaattcaaaaaactaataaaaaaaataactcaattaataacaaatctaatttatcaataacatactaatacctataacaattactaattatctcaacaatatatctcaatttttatatttaatatattcttcatcattcttaaattaataaataacaaccaattattttctcttttacaaacttcatataaaaaaaaaattaaaaaaaaaaatttatattaacaaaaaataaatataaaaaacttcccaacctcccctccatatatttactaacaaacaactaacataaataataacaaaacaatataattaataaaaaataacgcaaaatatacaatttccttttttctaatattaatttattttctatactaacacaatcctaaaaattactattcaaaaaaaacatcgacaacaaaaataattaaaatactaattaaaaaaaaatttttaaaaaaataaccaatcaccatcaatcttaatattaactaacaaatatatatttttctttctcatattattaaataaataatataaacaaaataattctttattaatatatccatataataccttttacaaataaatataattctaaatattttataacctataattacttaaaatcgaaaaacccttttaatttctcttattacccatatattactaaaactaactaaaaaaccaattaaaaaatttattcgttcacgaaataacatttaaaaaataaatacctacttatcacataaaaaaatccaattatttacttaccctataaaaaaacataatatattaaaatacttatacactacaaataaaaaaaaatttttccaaaaatttaaattatacaataaaaccacacaatcttacttaaaaaaaataataaaaaaattttaattacaccataaaattttacaattttttaaatttttaattctaattttaaaaaacaaaataaaaaaattacaaaaaaaaacttcaccattaaacaaaaaatcaaaataattctaaaaaccgcgcaaacaaacttttccaaaaattaatcataaaataatacttaaaaaattcctttactccaataactttaaaacccccttctcactctccactaatctttcaaaaaattcataataaattaaatctaacgaatataacacgaccgaccgaaaacataaaactcacgctaccctttcaaaacgaaaaaattcccaaaaaaaaaaataaaaaaaaaaatcgcaattaaacaatcctcccaacctcaccaaaactccacctctctccaaaaccgcaaaactctaccacctacgccgaaaaaaactacaatcactatctcctcctctttctttctcttttttttttttcttttttacctaaaatacccgaccaaacgcaacccgcaatctaaacactaccaactaactccaactccttttataataaaaaaataaattcttcgttatttccccgcccaatctaatacccacccacccacccacctaccacgtccgctaaacgcacccaaatctaaccccgaaacgcacgcgctaacgcaaacaccgtatttcttctcctttctcgaccaaccctaaataaaatcctaaaacaactaccctctcttccacgatctaaatattacgacccgcgaacaaaaaattcaaaaaataatacactccgaacgacaaacaacgaaacgaaaacgatcgccgatttcaataataaccccactaaaaaccgaattcaaaaacgactaaacgatcgccgaaaaaaacaccgaaacttcccaaaatcccctccgaattcccactccgcacctccgaaaacgtaaaaaccacgaaaaccgccccaccccgcgcgcccaaccccgccccaacccaaacaccgccccccgccaatcttccctacgacgcccaaaaaaaacgcgctccgcccccttccaatccgaccaataaacgcccgaacaacgcgcgatttacctccgcctccgccaaaaaaacttaaaaaaaaaaaaaaatttatacaaaaaataaaaaaacgaaaacgaaactccaaacccgacaacccgaaaaaaaaataaacaaccccaaaccaaaacctctaacaaaataaaccccgaaccgcccccaaataaccaaaaacgacctcaacgacaaccgcaaactccaataaccgcccgtactacccgtaactaaaacgaaaaacaaccaaaactaaaaaccaaaactccgcgccacctacgcgcacaacctcacacctaaacgctatcctcccgcaaacgaaaccgacgaacactacaaaactaaaactcgtctttaaaaaaaaaaaaataacgaataaaaaatccaacaccattcttcactaacccatcccgctacacctcttatttcccaaatttttaaaaactaacaactctaacctcgatatccaaaaatcgacaaccactaaaaccgactttaaaaaaccgaaaatttaacaatttccaaactaaacaaaacaaaataaaaacaaattaaaaacgaatccaaaacatctaaaaactaaccctaaaaactcgtaaaactaccaccgctactaccgctacaaataaaataacgttaaactaacgttaaaatcaacgaataaaaaacgcaaaaatacgaccctcgccgaaaaaaaccaaaaaaaaaaaaacgcgctctccaaattacttttataacttattttcaataaacattttattaattcaaaatctatcgaaaataacactaacgaactacttttcccttaaaataaatcttattcatcttaacaataaaataaattaaattataaaaaaaaaaaaaaataaaaaaatcaatttataaatattaatatcaacaaaaatatactattaacaaaacgtatcgcgaacctaaaaattttaataaccgcaattaataaataactacaatccaaaaaataaaatcgaattactccccttatcttatcaatatatcgtttctcgaacgcgaatctaacaccttacaaataataatttccgctcacgacaactttatctctcttctaccatccccaaacccaaccttacactccaaaactacgcaccgccaaccactatcatatccactcccgaaatcaattcgtccgcctccttaaaccccgaccgactaaacaacccaataaccatcccgacgataatattcatcttcgaaataataaacaacctaataaccatcgtaatactatacaaatcgcgcaaaaaacaaaaaaaaacgaccttctacacgctaatatataaactaactatcaccgacctattaaacactttattaataaacccgataaccatcgccacgtacataaaaaaccaataacccgaaaaccaaccgctatacgaatacaacaccttcattctactcttcttcaacctatccgacctcaacatcatctacgccataaatatcgaacgctacctaaccatcaaccatacctatttctacaaccactacgtaaacaaacgattaacgaacctcacgctctttacaatctatacgtccaacgtactcttttacgcgctacccaacataaatctcgataactcgcgactacaatacccaaacacctaatacttcatcgactaaaccaccaacgtaacgacgcacgccgcctactcctacatatacgcgaacttcaactccttcctcattctcgccaccgtcctctacaacgtacttatatacgacgcgctactccgcatacaccgccaattcatacgccgcacctcgctaaacaccgaacaacaccacgcgaccgcgaccgcctcgattacctcccgaaaccaccccgctacctccccaaccttaccgcgcctcaacgactttcgacgccgccgaaacttccgccgcatcgcgaacgccgaaatccaaataatcatcttactcattaccacctccctaataatactcatctactccatcccgctcgtaataaataaccgaaactaaaaccctactcgacctttttctcgcatccacctcccgcgtccattccccgctccctactttccctctaaatccttaacaataaacgtatcgcctttaaatcgaaactaaaattcccacactatttctcaaaacaaacccaaccctctttaaaatcccaaccctaacgaaatttaacaaatactttacccctacatcccccaatttatattcccgaaaacctaaatttctttctccaccgaaacaacccttaccccttactacctaacactaaccgaatcttccaaaaaaaccccccgccccctctattaaacgtaaaaaaaaacctactataatataacttaacccattcctccgtactataaactataaactacaaaacctaaaatatcaaaaataataatctattcgttataaaccatttttaaaaaaaataaaatttttaatattttaatatatacaaaatttcttaaatttcttcccccgtaaattacgtaaaattttaaaactaaaaaaaatatcaaaaaatattttaatctaactccctcacttcactaaaaaaataaataatacgcttaaaataatccaaccgaacctacacaatcaaactaaactccctactctttaccataatataccctaaaaaaacaacttaaaacacacaaattctaattcatatacaaaacaaaatccaaactcaatttctttcattctatctaaaccaaaaaaacaaaatttctcaaaataactaattataaacaaactaatatacataaaatataaaatttaaattctcgacaactatacgaaatacaataccattttaaaaaaaccgaaatttaaaaataactatctttatttcttcaaaccaaaactctacaacttataataaaccttaaaccgtctaaaaccaaacccaactcatatattattacatcacgtctccctcgtaaaacatttctcattttaacgtttataaaacgtaaattaaaattttaatacacttcatttttaattcatcttttaaaaattacctttaaattaacttttaaaatataataaacaaaaaaactcaaaccctacctaattttctactttacctataactaaaataaaatacaccaaaaacaaataaacaaaataatacaatactttatctaaaatttctcttaaaaacaactaattataaattcttccatcttccaaaacactacattcctaaaaattctaaactaccaactcaaaaaaaaataactactttttcttatacttattaaaaacaaaaaaatataaaatataataaactattattccttccttttccttattaatactatccaaaaatctttaatataaaaatatatctttaataaaaataactataaataaaaaaaacttaaaaaaaactcaaaaccaaaatacaataaattcttaccaatttatataaacaaaaataaatataataaaccataaaaacctttaaaccattccaaaacccaatataatttacaaaattaaatcacacttaaaccacataaatatattttactatctataataacaacctaaaataaaataaaattttaaaaaaaacaacactactcctaataaaacccctattcctaaacctctaccttatattttacaaaacaataaataacaaaataaataattattattttcaaaacatccacttaaaaaaacaaaaaaattaaaactaaaaaattaacaacatacacatactttataaatatattttaattaaaaataaacatataaaactataaatttctacacaaccacgaataaattattttcttccaacatctaaaaaaacatacaaaacttaattcacctcataaactaaaataataaacctaaacctaaaattcaaaacccttacacaaaaccttaaaattatttaaaaacctaaaaacaaaaaattataaaaactatatttataatttacaaattaaccacattttaactaacaaaaaatactatccacctatataatattaataacgtataataaattttaaataatcttaacctaaaaattaaaactaactcaattaaaaaataatcccattaatcaaatatttatataactttataaaaaataaaaaatcctaaaataacaataacatcaatttatcgcctttaattttaactactaaaatctaatttcaaaatcaatttaattataaattaataataaataataaattcattataccacccacccacccccccccccacaattcaacaattactaaaataatcaaaaacccttccgcaaatacaatcttccttaacttccttttacaactttcttttttcatattttcatattcatattataaattaaaattaaaactcaaaactctctaacattaaaaacaattaaacttatcttcaattccaaaaaaactaataaaacatctaattttatcaaatcaaataattactaatcccatttaaaaaaaatcaaaacgttaaaatcattttaaatactttaaaaaaactaacaaaacaaatataatttacttaaaatttcaaaaaacttaatataatacctaaaaaaaacaaacaaccactaaaaaacaaccaaaattttacctcctaaacaccaaaaaaaaaaaaactacaactcttaaaaaaaaattaatattaaatttaatataaaaaataaattttaatttactatccaaaatatacatatttcataaataaaattaaaattaaaataaaaatttaaaaaaaattaaaaaattaattataaatataaaaaactatactaaacctacaacattctttaaactaaatcataattaataatcaaaaaaaatataaatataatctacaaaaaacatcacataacaaaatttaataaataaataattcttatcattttatccattcttctatttataaccaatctcataatttttttaaatataaaaaaattttaaaaataaaaacttctaaaattttataaaaacaaaaaataaaaatctacatttaaaataaacgaaaaaaattaaattctttaaaaatatacaaacaaaacaacctcctaaaatcctaattttaaatactataacttaataaattactaatacctaattttacaattactaataaatattaaaataattattataatcaaatattttaccttaaaactaaacaattactataaaatttcgaaaatcattttcccccatacacaaacaacccaaaactatatttattacttacttatttcttttattttttaactctaaaataacaaatactcatctcaactaaaaacaaaacaactaatttaattaatcttctaccttaataaaataaaacttaaatccttaaaaaaatacttcctataactatttatttaattccttactataaactaattatctctataaaactttcaccaacatttaatcaacaaaaatttataaaaacaaataaaaactttataaataaatatacttttatttactataaacaaactaaaaataaaatcataaaacaactaataaaatatcaaataaatataaaacacatctatacatacaaaaaaaataccacaaatttaaatataactataacaaaatctaaaaaactaaatttattcaaataaatttaactaaatttaaaaaattacaatacctaaaaaaaaattttaaatcataacatacaattacaaacccaataataataacctaaaaactattaaataacataaaaataaattatttccacatctaacatttcatttaaatcttaaaaaactctaaaaaaaaaataaaactaaccaatattttcactctctctacacctcaatttcccaaactacaaataaaaaatttatatcattctacaacttacaaaataactataaataaatcctcgtctaatactcatttcaccatactttcttaacctatcaatttatttatattaaatatctcctaacaaaattttttttctcaaccctaacgtaattcttataatctcctatcaaaatattcaatataaaaactttaaaaacaaacaaataaaaaaaaacaaaaactttcaatataaaaattaacctataaaacctataaaaatttaacttaccttctacaaataaccaaaaaaaaaaccaaactctcctacacaccacccaatcaataattatttccactattctttacttaaaaaaaaaaaaataataaaaacttctaataacaactatatcaattttaaactcttaacaaaacaataaaataactaaacccatacaaataattccttttatatacttaaaacaaaacaaataacacacacattcaaatccaactacaaatcttatcacttattaaaaaacgttactattttaacaatccattactaaatctaatcaaaaattcaacattctttcttcaacattccctacaaacaaattattaaataaaaaatacatatttttaataccatattattaactatatcccaaaactacctctaaactacaattttcaaattattaataccttccacactaaacaaacttccacatataaattaaaaaaaaaaataataaaaaccaacatatctattatacgataaacactatactaaacactttaataatttatacatacgttataaaaacaaaaccaaaatttaaacaaaaacttatttacttccaaaacttaaacatttatctctacaacatataacctccttacaactttcttatcaccacatcttcttctaaacttattacatttcctcaaaattatattccactactcctaaaccctaatctctaatcatcctaaaaaaaaatataaataacataatttaaaaaaaattaaataaatataataacatatacctataatcccaacaacttaaaaaattaaaactaaaaaattacttaaacccaaaaaattaaaactacaataaaccatatttatatcacaacactccaacctaaataacaaaataaaaccctttctaaaaaaaaataaaataatttaaaatactataatataccaatattaacaacaaaccacatatacacaacaaaaactactaaaaaaaaacttaaaattaaaaaaaaaaaaatacgttatttatattcaataaatttttttatttttatttttatttttatttttattttaaaacgaaatttcactttataacccaaactaaaatacaataacgcaatctcaactcaccgcaacctccacctcccgaattcaaataattctcctacctcaaccttccaaataactaaaattataaacatacaccaccacgcccgactaattttatatttttaataaaaactaaatttctccatattaatcaaactaatctcaaactcctaacctcaaataatccgcctacctcaacctcccaaaatactaaaattacaaacataaaccaccatacccgaccatattccctcctaactcgaaaattcaattttatcaacaacacactcttccaacactaaaaactacctaaacttatttaattatataaaatataaaacctattaaacaaaaattccgaaaaatactttcaccccctcacgaaacattaaaacactactccgaatatccccatctcaactaaaattatccctaccctcttaaaaacaacaaatcaaataacctacttaaaataaaacaaaaattactctatattttcaaacattacaaaatacgtaaaatttttatttattttatcttttttctttccctacttaaaataaatctcaattaaaatacgctacaaaataaaactcatattaattcttttcaatctaaccaacttttaaaaatatttttacctaaatttaaacttttactttttaaactcatacttttactaccctataaactcccctttattaaaaaaacattaaataaccaaattcaataacttatactaattataaacttttcctcccccataaaaaactttaaaataaaacatacttttaatataacctcctttcattccctcctatactaatcgaaatccattactactataaataaaataaaacacaaaaataattctttccttacctctcatcacctttaattataaaaacctattattaattattttacaacattccaacctttctaaaaaaccacaaaaattttaaaatactaactcctaatatacttctttaaataactataaattccattttaactattcaaaaattttcttcctttcaataataaccatatttcctttaaaattataataaaaaaaacaaccaacaataaaacattttcaatatcaaaaatctcaaaaacgtcaaattcaaacttaaccaaaattctattctacgaatctcgaaaataactttacacaatacttattaaaaaaataatatcaaaaactctcaaataaaacaacactaccacctaaaaacttaaaaactcaaattcgcataaacccgaccgtaaatcttttccaaaaaccacacacaaaacttaatactaacaaatttaacgccatcatttcttctacccttaaaaacgtaatatataatataaataaaatataaacctcatactttttaccaacaattccattatcaaaaaataataattaaacaaaaaaccaaactaataaaacaaaaaaaacaacataaaaatccaaaccaaactctaccaccaacaaaataaaaaacatcctaaattcctcaaaacctctaaatctcaataacaaatacctcatctaaaaaaaaacctataaaattaaaaaaactactaaatttccaaacataactaaaaacctcaaaacttataaaaaaaaaaaaccaaaatactttattttactttctataaaaatttttttttaaatcaaatatactttaccttaatactatcatttatcccaacgtaatttctaaaaatatttcaaaaaacgatattacacactactattcattctaattcattcttaatttaactatcttccatataaaaaaatattaatttcatcttaattaaaaacatatcactattttattctctaaaatttacaaacccataatcccatatccaaaatatttacgaacaaataaatttcaaaattcaaaatttcttaacttttaaaaaaataatcaataatatattacaaaatatataatatccccatcaaaactaaaacaataatcctaaaccaaaacataaaaatattcactctaaataaaataaattaaactaaataacttcacaatctattcaattcaattttactaccaaaataaatttaaatcaaattttacaataaatataaattctcaaaacaaaacaaataaataacaacaaaacaataacaaaaaaaataaacaaaaatcttttaaaaaaaaatcaaaaacctataactaattaaaatctaaattccaattaaaaaaaaaaaaaaaatacaattctaccttactaatccaatatcatccaaaaataaatttaatataaacttaattttacaaattaataaaatatatttcttcgaatattttaaaaattcaaaaaatctttaaaaaaaaaaaaaaataattcttccttcttttacccaaattttacccaaattattaaaaatctttctataatatcctaacccaaatattattacatctaataaataccaaaaaaacacatacaaataatcaataaatcgccttttccgttataaactaactcaacctcaactaaactatccctattccaaataattcatacaccataaatcattcattattacgctatatataataaaacaacaacatcctcaaatcttattaaaaatatttacccctaattaaataactccaactatacttttattaattctttctcctttttataatttttatatatcttccttaactataaaactcaacctcttctccctaacctaaaataattactaaaaacaaaaaataattactaaataattacttaaaatatataacaattatttttatttctatactactatttctatttctatttctatataaattaccactactactatttctatattaattacaaataaaatttttatataaataatcccaataaaattaaaaataatatctaaacaaaaaaaaatcataatactttaaaaataaatttaaaactaaacataataactcactcctataattttaacactttaaaaaactacaacgaacaaatcacttaaactcaaaaattaaaaaccaacctaaacaacataaaaaaacctcatctctacaaaaataataacaattaaccaaacataataacacacacctataatcccaactactcaaaaaactacaacaaaaaaattactaaaacctaaaaaatcaaaactacaataaacaataattacaccactacactccaacctaaacgacaaaataaaaccctatctcaaaaatatatatacatatacatttaacaaatacattttcccctaaaaattaaaataatcatataaatttacacaaattcatactccattcgctaaatcatttaaaattcccaaatattaacatatcatttcattcttccataactttacacataaaactacctctatttaaaatataatatctttccttctaaatttaacaaattctcattcatccgttataattactataactaaaaaacaaaatcataaaaaaaataaaaactattctctaatcattctaaataacaaaaaatcctactattaatataaaacttttcaacatattctttctaaactaaaataaaaaaatcttaaccttattctaataattaaataattaattaacttataaaataaatttcctttaaattatataaaataacaactaaaataaaaaatcaataacttttaaaaaaaaaaaattacttcattaaaattacaaaaacttaaaaacactcacaaaaataaaattaataaaatacttctcaaaaacactttatacatatataacctacactcacattacatttttatatactatctttactctaaaaaaaataatcataaaataattacaaaaatattaaaactatacgaactcaaaacatataattacatttttacaataactaatttttatttttttattttttatttttaaacaaattcttactctattaccctaactaaaatacaataacatcatctcaactcactacaacctccacccgccgcattcaaaccattctcctacctcaccctcctaaataactaaaattataaacgtataccgccacacctaactaatttttatttttttaaaacgaaatctcgctctatcgccaaactaaaatacaataataaaatctcaactcactacaacctccgcctcccaaattcaaataattctcctacctcaacctcccgaataactaaaactacaaacgcataccaccacacccaactaatttttatatttttaataaaaataaaatttcaccatattaaccaaaaaattctcaatctcttaacctaataatccgcctacctcgacctaccaaaatactaaaattacaaacgtaaaccaccgcacccaacctaatatttatatttttaataaaaataaaatttcgccatattaaacaaattaatctcgaactcctaacctcaaataatcctcccacctcgacctcccaaaatactaaaattacaaacgtaaaccaccgtacccaacccataactaatttttctaaaacttattatataacttcctcttttcctaaaacttattaccaaaaataaaaacaacttcctaatattaataaaataaacataacatttatatattttcccaattaattaataataaaatctaaatatacgatctcacttatacaaatacgaatattcgtcaaccaattatatcaaccaaatttaaaacgaaaaatcaataaaaatccaaatttacaaaccatccgaattacttctataaaccccatcctaaacccctaaatatatatcctcctaaaaaaaacaatactcaataaaacaataaaaaaaatcaaatacctcttctaccgcattaacgaatcccgcaaaaaacgctccgaacaacactactcaaacaatcaaaaaacatcttctaccatatcaaaccactctcgctccttcatctcccgaaaactaaaaaaaatcaacaatacatctcaaaccctcctaccaaacctctcactaccaaacctcaataaaaataaccttaaaaacaaaaatttacttccaaatatacctaacataaacctaacccaaaaaaacaccacctcactaaaaactttacgaatatcaaaaacctcaaactcttcacaaaatcaaaactcaaaaaatatcttactaataaataaaactaataaaaacgacaaaactaaacctacccctaaaaaaaactccctacaaatcacatttcccaataaaacactaaacttatcaaaaaaatatatataataaacaaaaaaaaaaatacaatactatttctaaacccttataaaatcctatacaataaacacatacatatcacatttaactatactcaaaaaaactatcatcatcctacaactcacattaaaaaacatcctaacttttaaacacttttcaaacaatcaaattaactcacgtaaatcctaaaacctacaacacgtcgaatactaccccactataacaaaaaattataatcacaacttaataactacgaaaacctaccctccgtttttctactaaataaaaaaataataaaaatttaactactatcataacatccaaaactttatcgtatttaacacacaacaaaaacccaaatattaaaaaaactctattccaataaactataaaaactaccttataaataatttaaatatctcactaaaacataaaatataaatttttattattatacatacgatttaaaatatttaaaatattttcttctctataaaaaaatttattattaatacaaaatataataaaattatcgcaacccctctccttccaatataaccaactaaaattacaaatattaaatatttttcataaacaaattcgaatcaaaattaaaaattcataataaaattaatatctataaaataaatataaatttttaaaaaaaaaaatttaatattatcaaaaaaataaaaaaaaaaatactatttaaaatataaaaattacaatccaaaatactattctttccaaactatatataaaatacataataaaaattatttaataatattacatttatttatccaaaaaactataatttcaaaaaaacctaacatactaataaatattttcaactttttccctcactaattaatacttttaaaaacataacataaattttttaaaatctttaataaataacccataattaaaatatataatataaaaaattttaaaaatctaaacaacttattatttctctaaaaatatatataattttactttcctaaaaaattaccaaaaatatcctttaaaatttaaaaaaataacaaattacatcaaaaaactttattttaaaatataaaaaaattcccaaacgtaattacattaaccattcatatatatcaaaaatacaaaattaaaacacttaataatcaccttataacaattttatataactcccaataatactatacacatatttaaaaaatctttctcaaaaaaatattaaacatattttattactcaatatttttataaattacttaattataattaaattctaaacctaatattaatataattttaaaaaacaattataccaaataaaattattttaaaaattataataaatatatacattcaatctaaattacatatcctcaatttaaaaaaacttataaaaacttttttattatttcaaatcatcatctatatccttttatatatttttttaaaatttattataaaataattttaaaaaaatattacaaaaaaaatacaaactcttatatacacttaataaaaaataacactttactcaaaacctccaatttatataaataataaaaaaaacaatattatacttaacttataacatataaaaaactcaaataattattactaaaataaacatattttaaattttacaatttttttaactaccatttttatttttatttttttattttttatttttaaaacaaaatcttactctatcacccaaactaaaatacattaacacaatctcaactcactacaacctccacctcccaaattcaaacaattctcatacctcaacctcttaactaactaaaattacaaacgtataccaccatacccaactaaattttatatttttaaaaaaaacatatcataccatattaaccataattaatctcaaactcctaacttcaaacaacctacccacctcaacctcccaaaatactaaaattacaaacataaaccaccatacccgaccatttttacatttttaaatacaaattttattcattttttaaataaattatatatctacattaatcaactaaaactaccataaaataccacaaataaataacttaaacaacaaacatttattttctcacaattataaaaactaacaatccaaaaccaaaatatcaacaaaattaatttctcttaaaccccctctccttaacttacaaataactcccttctttctatatcctcaaataaccttttctccaaataaacacatccctaatatctctctctccttataaaaacactaatcatactaaattaaaaccccacccttataacttcatttaaccttaattactctcttaaaaaccttctctccaaatataatcacaataaaaattaaaacttcaacaaataaattttaaaaacaaatatccttttcattattaaacctaatttattcttaaaataacaaccaaaaaaaataaattccaacattactcaatcatctattccatatttatttataaaacttaacaactatacaatacaaaaattattttttatttcttactataaaacacttattccaaaccatttaaaaaacttcaaattttctacacaaaaaaattctaattatctaattaactactattaaatcctaccatctcaaaaaaatataacaaacaaaaaaataattttaacaccatattataatctttaaaacaatctaaccgattaaatcaaatatattaaaaaaaataaatttacaaaactattaaaataatactttaaaccaaatacaataactcacacctataatctcaacactttaaaaaaccaaaacaataaatcacttaaaatcaaaaattcgaaaccaaaataaccaacataataaaactctatctctattaaaaatacaaaaattaaccaaacgtaataacttacacctataatcccaacactttaaaaaactaaaaaaaacaaatcacgaaatcaaaaatttaaaaccaacctaaccaacgtaataaaacctcatctccactaaaaatataaaaattaaacaaacataataacgaatacctataatccaactacttaaaaaactaaataaaacaaaaaaatcgtttaaacccgaaaaacgaaaattacaataaaccgaaatcgtacgactaaactctaacctaaacgacacaacgaaactatctcaaaaaaaataaaaaataaatacaaacattaactaaacataataccgtatacccaactactcaaaaaactaaaacaaaaaaatcacttaaacccaaaaaacgaaaattacaataaaccaaaatcgaccactaaactccaacctaaacgacaaaaaaaaactccgtcgaaaaaaaaaaaaaaataatactttatacgatcataaaaaaaaataaattcatatccatatcctttaaaccaataaaataaaaataaaaaccactatcctaaataaactaactcaaaaacaaaaaaccaaatactacatattctcacttataaataaaaactatacaataaatacacataatcataaaaataaaactaatactaaaaactccaaaaataaaaaaataaaaaaaaacaaaaattaaaaaataacctactaaatactatattcactatttaaatactaaatacactaaaaacccaatccccaccaatatacaatatacccatataacaaacacacgtactccccgaatctaaaataaaataataaaataaaaaataaaataatactttaaccaaaaaaccacaaaattcaaaaattctttcccaaatcataactaatcctctccacaaattttctcctaaaaacataaatacaaaaaaaacataaaaaaatcaaaacacaataatatttactattaactatccatataacctcaaatattaatacaaaaaaatttccattacacaaacattcaattttcctaaaatacttatactaatctcaaaacaaaccatatttaatttcttccaatactacccccacctcatacccttctcccgttacatccaaacctaaatctaaaatactacaattataatctcaaaattatcatccaaacacataaaaaataaaacccaaaaaaacaaaacgcttacaacaaaaaaaaacatttaatcccattacttactataaaatttctctaaactacaactaatactttaaccccaaactaaaaataccttaacaaaaaaaaaaaaaaaaaaataactaaatctttaatccttctatcaacatctctaccattcaatcatttatccattccctttaccttaccaaaccatcaaccccatttcccaccataaaaaaaaaaaacaaaaaaaaacaccaatcacttttcctaaaaacgtttaaccacaacaactctacacactaaaatctaaacaattaaataaatatttctctttcttaaaaaaaaataaaacaaaatttaatacaaaaaaaaaacaaaaaaaattccaaaaacaataaacaaaaactcaaaacaacaactctacaataaaacaaaaacacaataaaaccatactaaaacaaaaaaaaaatctctataatatccccataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaacacaataactcacgcctataatcccaacactttaaaaaaccgaaacaaacgaatcacctaaaatcaaaaattcaaaaccaacctaaccaacataaaaaaaccctatctctactaaaaatacaaaattaaccaaacgtaataacgcatacctataatcccaactactcgaaaaactaaaacaaaaaaattacttaaaccccgaaaacgaaaattacgataaactaaaatcataccattacactctaacctaaacaacgaacgaaattccatctcaaaaaaaaaacaaaaaaacaaaaaaaaaaaaaaaaaaaaaaaaaataataaattatttaatatttaacaaaatcaaaaaaaatattataattctattaaaaaaattaataaaaatatacataaaaaactaataaatttaaaaaaaacaattattaactccataaaaaacaaaaaaaaataaaaaaaaaacaaaataaacataatatacaaaataaactaaattatatataataaatatactcatatcaaataataaatatacaatcaaatacaacgactcacacctataatcctaaaactttaaaaaactaaaacaaaattacttacacaaactccttttatacaaccataaaaaaaaataaaatcatatcctctacaataacacaaataaaactaaaaaccattatcctaaataaactaactcaaaaacaaaaaaccaaataccacataatctcacttacaaaattcaaaacctatctaaacaacacaataaaaaaccctatctctacaaaaaaaaaaaaaaaaaaaaaaaaaaaccataaaaaattaaccaaacataaaaacatatacttataatcctaactactcgaaaaactaaaacaaacaaatctcctaaaccataaatttaaaattacaataaactaaaataataccactaaacaccaacctaaacaacaaaccaaaaccctatctctaaaatttaataataatcatcatcatcatcataaacataaattaaaacctaaattataattatactaaaaataaaaaaaaaaataataaatatattaaaaaaatacaaaaaacctaaattataattatactcatcaatataccaatacttaatatcctaaatttttaaaaataaaaaaataacaataaaaccacaataatatacccttatactccaaacatatttacaaaatatataaaatataaaaataccaaatatacttcaaaaaatatactattcttaaaaatacaaaattaatacaaccactttaaaaaataaactaaaattcaaaatatatataccatcaataaaaacaataactaccgaaattaaaacacatcaattatatctcaatacattactttataatacgacaaaacaaaacacctcattaatcacctttaaaaaaatctaaaaaa

SEQ ID NO: 55 - DNA, 24238 bp, Artificial Sequence
  bisulfite converted genomic DNA
ttttttagatttttttaaaggtgattaatgaggtgttttgttttgtcgtattataaagtaatgtattgagatataattgatgtgttttaatttcggtagttattgtttttattgatggtatatatattttgaattttagtttattttttaaagtggttgtattaattttgtatttttaagaatagtatattttttgaagtatatttggtatttttatattttatatattttgtaaatatgtttggagtataagggtatattattgtggttttattgttatttttttatttttaaaaatttaggatattaagtattggtatattgatgagtataattataatttaggttttttgtatttttttaatatatttattatttttttttttatttttagtataattataatttaggttttaatttatgtttatgatgatgatgatgattattattaaattttagagatagggttttggtttgttgtttaggttggtgtttagtggtattattttagtttattgtaattttaaatttatggtttaggagatttgtttgttttagtttttcgagtagttaggattataagtatatgtttttatgtttggttaattttttatggtttttttttttttttttttttttttttgtagagatagggttttttattgtgttgtttagataggttttgaattttgtaagtgagattatgtggtatttggttttttgtttttgagttagtttatttaggataatggtttttagttttatttgtgttattgtagaggatatgattttatttttttttatggttgtataaaaggagtttgtgtaagtaattttgttttagttttttaaagttttaggattataggtgtgagtcgttgtatttgattgtatatttattatttgatatgagtatatttattatatataatttagtttattttgtatattatgtttattttgttttttttttatttttttttgttttttatggagttaataattgttttttttaaatttattagttttttatgtatatttttattaatttttttaatagaattataatattttttttgattttgttaaatattaaataatttattattttttttttttttttttttttttttgtttttttgttttttttttgagatggaatttcgttcgttgtttaggttagagtgtaatggtatgattttagtttatcgtaattttcgttttcggggtttaagtaatttttttgttttagtttttcgagtagttgggattataggtatgcgttattacgtttggttaattttgtatttttagtagagatagggtttttttatgttggttaggttggttttgaatttttgattttaggtgattcgtttgtttcggttttttaaagtgttgggattataggcgtgagttattgtgtttggtttttttttttttttttttttttttttttttttttttttttttttttttttttttttttttttttttttttttttttttttttttttttttttttttttttttttttttttttttttttttaatttttttttttttttttttttttttttttttttttttttttttttttttttttttttttttttttttttttttttttttttttttttttttttttttttttttttttttttttttttttttttttttttttttttttttttttttttttttttttgtttttttttttttttttttttttttttttttttttttttttttttttttttttttttttttttttttttttttttttttttttttttttttattatggggatattatagagattttttttttgttttagtatggttttattgtgtttttgttttattgtagagttgttgttttgagtttttgtttattgtttttggaattttttttgttttttttttgtattaaattttgttttatttttttttaagaaagagaaatatttatttaattgtttagattttagtgtgtagagttgttgtggttaaacgtttttaggaaaagtgattggtgtttttttttgttttttttttttatggtgggaaatggggttgatggtttggtaaggtaaagggaatggataaatgattgaatggtagagatgttgatagaaggattaaagatttagttatttttttttttttttttttgttaaggtatttttagtttggggttaaagtattagttgtagtttagagaaattttatagtaagtaatgggattaaatgtttttttttgttgtaagcgttttgtttttttgggttttattttttatgtgtttggatgataattttgagattataattgtagtattttagatttaggtttggatgtaacgggagaagggtatgaggtgggggtagtattggaagaaattaaatatggtttgttttgagattagtataagtattttaggaaaattgaatgtttgtgtaatggaaatttttttgtattaatatttgaggttatatggatagttaatagtaaatattattgtgttttgatttttttatgttttttttgtatttatgtttttaggagaaaatttgtggagaggattagttatgatttgggaaagaatttttgaattttgtggttttttggttaaagtattattttattttttattttattattttattttagattcggggagtacgtgtgtttgttatatgggtatattgtatattggtggggattgggtttttagtgtatttagtatttaaatagtgaatatagtatttagtaggttattttttaatttttgtttttttttatttttttatttttggagtttttagtattagttttatttttatgattatgtgtatttattgtatagtttttatttataagtgagaatatgtagtatttggttttttgtttttgagttagtttatttaggatagtggtttttatttttattttattggtttaaaggatatggatatgaatttatttttttttatgatcgtataaagtattatttttttttttttttcgacggagtttttttttgtcgtttaggttggagtttagtggtcgattttggtttattgtaattttcgttttttgggtttaagtgatttttttgttttagttttttgagtagttgggtatacggtattatgtttagttaatgtttgtatttattttttattttttttgagatagtttcgttgtgtcgtttaggttagagtttagtcgtacgatttcggtttattgtaattttcgtttttcgggtttaaacgatttttttgttttatttagttttttaagtagttggattataggtattcgttattatgtttgtttaatttttatatttttagtggagatgaggttttattacgttggttaggttggttttaaatttttgatttcgtgatttgttttttttagttttttaaagtgttgggattataggtgtaagttattacgtttggttaatttttgtatttttaatagagatagagttttattatgttggttattttggtttcgaatttttgattttaagtgatttattgttttggttttttaaagtgttgagattataggtgtgagttattgtatttggtttaaagtattattttaatagttttgtaaatttattttttttaatatatttgatttaatcggttagattgttttaaagattataatatggtgttaaaattatttttttgtttgttatatttttttgagatggtaggatttaatagtagttaattagataattagaatttttttgtgtagaaaatttgaagttttttaaatggtttggaataagtgttttatagtaagaaataaaaaataatttttgtattgtatagttgttaagttttataaataaatatggaatagatgattgagtaatgttggaatttattttttttggttgttattttaagaataaattaggtttaataatgaaaaggatatttgtttttaaaatttatttgttgaagttttaatttttattgtgattatatttggagagaaggtttttaagagagtaattaaggttaaatgaagttataagggtggggttttaatttagtatgattagtgtttttataaggagagagagatattagggatgtgtttatttggagaaaaggttatttgaggatatagaaagaagggagttatttgtaagttaaggagagggggtttaagagaaattaattttgttgatattttggttttggattgttagtttttataattgtgagaaaataaatgtttgttgtttaagttatttatttgtggtattttatggtagttttagttgattaatgtagatatataatttatttaaaaaatgaataaaatttgtatttaaaaatgtaaaaatggtcgggtatggtggtttatgtttgtaattttagtattttgggaggttgaggtgggtaggttgtttgaagttaggagtttgagattaattatggttaatatggtatgatatgttttttttaaaaatataaaatttagttgggtatggtggtatacgtttgtaattttagttagttaagaggttgaggtatgagaattgtttgaatttgggaggtggaggttgtagtgagttgagattgtgttaatgtattttagtttgggtgatagagtaagattttgttttaaaaataaaaaataaaaaaataaaaataaaaatggtagttaaaaaaattgtaaaatttaaaatatgtttattttagtaataattatttgagttttttatatgttataagttaagtataatattgttttttttattatttatataaattggaggttttgagtaaagtgttattttttattaagtgtatataagagtttgtattttttttgtaatatttttttaaaattattttataataaattttaaaaaaatatataaaaggatatagatgatgatttgaaataataaaaaagtttttataagtttttttaaattgaggatatgtaatttagattgaatgtatatatttattataatttttaaaataattttatttggtataattgttttttaaaattatattaatattaggtttagaatttaattataattaagtaatttataaaaatattgagtaataaaatatgtttaatatttttttgagaaagattttttaaatatgtgtatagtattattgggagttatataaaattgttataaggtgattattaagtgttttaattttgtatttttgatatatatgaatggttaatgtaattacgtttgggaatttttttatattttaaaataaagttttttgatgtaatttgttatttttttaaattttaaaggatatttttggtaattttttaggaaagtaaaattatatatatttttagagaaataataagttgtttagatttttaaaattttttatattatatattttaattatgggttatttattaaagattttaaaaaatttatgttatgtttttaaaagtattaattagtgagggaaaaagttgaaaatatttattagtatgttaggtttttttgaaattatagttttttggataaataaatgtaatattattaaataatttttattatgtattttatatatagtttggaaagaatagtattttggattgtaatttttatattttaaatagtatttttttttttatttttttgataatattaaatttttttttttaaaaatttatatttattttatagatattaattttattatgaatttttaattttgattcgaatttgtttatgaaaaatatttaatatttgtaattttagttggttatattggaaggagaggggttgcgataattttattatattttgtattaataataaatttttttatagagaagaaaatattttaaatattttaaatcgtatgtataataataaaaatttatattttatgttttagtgagatatttaaattatttataaggtagtttttatagtttattggaatagagtttttttaatatttgggtttttgttgtgtgttaaatacgataaagttttggatgttatgatagtagttaaatttttattatttttttatttagtagaaaaacggagggtaggttttcgtagttattaagttgtgattataattttttgttatagtggggtagtattcgacgtgttgtaggttttaggatttacgtgagttaatttgattgtttgaaaagtgtttaaaagttaggatgttttttaatgtgagttgtaggatgatgatagtttttttgagtatagttaaatgtgatatgtatgtgtttattgtataggattttataagggtttagaaatagtattgtatttttttttttgtttattatatatatttttttgataagtttagtgttttattgggaaatgtgatttgtagggagttttttttaggggtaggtttagttttgtcgtttttattagttttatttattagtaagatattttttgagttttgattttgtgaagagtttgaggtttttgatattcgtaaagtttttagtgaggtggtgtttttttgggttaggtttatgttaggtatatttggaagtaaatttttgtttttaaggttatttttattgaggtttggtagtgagaggtttggtaggagggtttgagatgtattgttgattttttttagttttcgggagatgaaggagcgagagtggtttgatatggtagaagatgttttttgattgtttgagtagtgttgttcggagcgttttttgcgggattcgttaatgcggtagaagaggtatttgattttttttattgttttattgagtattgttttttttaggaggatatatatttaggggtttaggatggggtttatagaagtaattcggatggtttgtaaatttggatttttattgatttttcgttttaaatttggttgatataattggttgacgaatattcgtatttgtataagtgagatcgtatatttagattttattattaattaattgggaaaatatataaatgttatgtttattttattaatattaggaagttgtttttatttttggtaataagttttaggaaaagaggaagttatataataagttttagaaaaattagttatgggttgggtacggtggtttacgtttgtaattttagtattttgggaggtcgaggtgggaggattatttgaggttaggagttcgagattaatttgtttaatatggcgaaattttatttttattaaaaatataaatattaggttgggtgcggtggtttacgtttgtaattttagtattttggtaggtcgaggtaggcggattattaggttaagagattgagaattttttggttaatatggtgaaattttatttttattaaaaatataaaaattagttgggtgtggtggtatgcgtttgtagttttagttattcgggaggttgaggtaggagaattatttgaatttgggaggcggaggttgtagtgagttgagattttattattgtattttagtttggcgatagagcgagatttcgttttaaaaaaataaaaattagttaggtgtggcggtatacgtttataattttagttatttaggagggtgaggtaggagaatggtttgaatgcggcgggtggaggttgtagtgagttgagatgatgttattgtattttagttagggtaatagagtaagaatttgtttaaaaataaaaaataaaaaaataaaaattagttattgtaaaaatgtaattatatgttttgagttcgtatagttttaatatttttgtaattattttatgattattttttttagagtaaagatagtatataaaaatgtaatgtgagtgtaggttatatatgtataaagtgtttttgagaagtattttattaattttatttttgtgagtgtttttaagtttttgtaattttaatgaagtaattttttttttttaaaagttattgattttttattttagttgttattttatataatttaaaggaaatttattttataagttaattaattatttaattattagaataaggttaagatttttttattttagtttagaaagaatatgttgaaaagttttatattaatagtaggattttttgttatttagaatgattagagaatagtttttattttttttatgattttgttttttagttatagtaattataacggatgaatgagaatttgttaaatttagaaggaaagatattatattttaaatagaggtagttttatgtgtaaagttatggaagaatgaaatgatatgttaatatttgggaattttaaatgatttagcgaatggagtatgaatttgtgtaaatttatatgattattttaatttttaggggaaaatgtatttgttaaatgtatatgtatatatatttttgagatagggttttattttgtcgtttaggttggagtgtagtggtgtaattattgtttattgtagttttgattttttaggttttagtaatttttttgttgtagttttttgagtagttgggattataggtgtgtgttattatgtttggttaattgttattatttttgtagagatgaggtttttttatgttgtttaggttggtttttaatttttgagtttaagtgatttgttcgttgtagttttttaaagtgttaaaattataggagtgagttattatgtttagttttaaatttatttttaaagtattatgatttttttttgtttagatattatttttaattttattgggattatttatataaaaattttatttgtaattaatatagaaatagtagtagtggtaatttatatagaaatagaaatagaaatagtagtatagaaataaaaataattgttatatattttaagtaattatttagtaattattttttgtttttagtaattattttaggttagggagaagaggttgagttttatagttaaggaagatatataaaaattataaaaaggagaaagaattaataaaagtatagttggagttatttaattaggggtaaatatttttaataagatttgaggatgttgttgttttattatatatagcgtaataatgaatgatttatggtgtatgaattatttggaatagggatagtttagttgaggttgagttagtttataacggaaaaggcgatttattgattatttgtatgtgtttttttggtatttattagatgtaataatatttgggttaggatattatagaaagatttttaataatttgggtaaaatttgggtaaaagaaggaagaattatttttttttttttttaaagattttttgaatttttaaaatattcgaagaaatatattttattaatttgtaaaattaagtttatattaaatttatttttggatgatattggattagtaaggtagaattgtattttttttttttttttaattggaatttagattttaattagttataggtttttgatttttttttaaaagatttttgtttattttttttgttattgttttgttgttatttatttgttttgttttgagaatttatatttattgtaaaatttgatttaaatttattttggtagtaaaattgaattgaatagattgtgaagttatttagtttaatttattttatttagagtgaatatttttatgttttggtttaggattattgttttagttttgatggggatattatatattttgtaatatattattgattatttttttaaaagttaagaaattttgaattttgaaatttatttgttcgtaaatattttggatatgggattatgggtttgtaaattttagagaataaaatagtgatatgtttttaattaagatgaaattaatatttttttatatggaagatagttaaattaagaatgaattagaatgaatagtagtgtgtaatatcgttttttgaaatatttttagaaattacgttgggataaatgatagtattaaggtaaagtatatttgatttaaaaaaaaatttttatagaaagtaaaataaagtattttggttttttttttttataagttttgaggtttttagttatgtttggaaatttagtagtttttttaattttataggtttttttttagatgaggtatttgttattgagatttagaggttttgaggaatttaggatgttttttattttgttggtggtagagtttggtttggatttttatgttgttttttttgttttattagtttggttttttgtttaattattattttttgataatggaattgttggtaaaaagtatgaggtttatattttatttatattatatattacgtttttaagggtagaagaaatgatggcgttaaatttgttagtattaagttttgtgtgtggtttttggaaaagatttacggtcgggtttatgcgaatttgagtttttaagtttttaggtggtagtgttgttttatttgagagtttttgatattatttttttaataagtattgtgtaaagttattttcgagattcgtagaatagaattttggttaagtttgaatttgacgtttttgagatttttgatattgaaaatgttttattgttggttgttttttttattataattttaaaggaaatatggttattattgaaaggaagaaaatttttgaatagttaaaatggaatttatagttatttaaagaagtatattaggagttagtattttaaaatttttgtggttttttagaaaggttggaatgttgtaaaataattaataataggtttttataattaaaggtgatgagaggtaaggaaagaattatttttgtgttttattttatttatagtagtaatggatttcgattagtataggagggaatgaaaggaggttatattaaaagtatgttttattttaaagttttttatgggggaggaaaagtttataattagtataagttattgaatttggttatttaatgtttttttaataaaggggagtttatagggtagtaaaagtatgagtttaaaaagtaaaagtttaaatttaggtaaaaatatttttaaaagttggttagattgaaaagaattaatatgagttttattttgtagcgtattttaattgagatttattttaagtagggaaagaaaaaagataaaataaataaaaattttacgtattttgtaatgtttgaaaatatagagtaatttttgttttattttaagtaggttatttgatttgttgtttttaagagggtagggataattttagttgagatggggatattcggagtagtgttttaatgtttcgtgagggggtgaaagtatttttcggaatttttgtttaataggttttatattttatataattaaataagtttaggtagtttttagtgttggaagagtgtgttgttgataaaattgaattttcgagttaggagggaatatggtcgggtatggtggtttatgtttgtaattttagtattttgggaggttgaggtaggcggattatttgaggttaggagtttgagattagtttgattaatatggagaaatttagtttttattaaaaatataaaattagtcgggcgtggtggtgtatgtttataattttagttatttggaaggttgaggtaggagaattatttgaattcgggaggtggaggttgcggtgagttgagattgcgttattgtattttagtttgggttataaagtgaaatttcgttttaaaataaaaataaaaataaaaataaaaataaaaaaatttattgaatataaataacgtatttttttttttttaattttaagtttttttttagtagtttttgttgtgtatatgtggtttgttgttaatattggtatattatagtattttaaattattttatttttttttagaaagggttttattttgttatttaggttggagtgttgtgatataaatatggtttattgtagttttaattttttgggtttaagtaattttttagttttaattttttaagttgttgggattataggtatatgttattatatttatttaattttttttaaattatgttatttatatttttttttaggatgattagagattagggtttaggagtagtggaatataattttgaggaaatgtaataagtttagaagaagatgtggtgataagaaagttgtaaggaggttatatgttgtagagataaatgtttaagttttggaagtaaataagtttttgtttaaattttggttttgtttttataacgtatgtataaattattaaagtgtttagtatagtgtttatcgtataatagatatgttggtttttattatttttttttttaatttatatgtggaagtttgtttagtgtggaaggtattaataatttgaaaattgtagtttagaggtagttttgggatatagttaataatatggtattaaaaatatgtattttttatttaataatttgtttgtagggaatgttgaagaaagaatgttgaatttttgattagatttagtaatggattgttaaaatagtaacgttttttaataagtgataagatttgtagttggatttgaatgtgtgtgttatttgttttgttttaagtatataaaaggaattatttgtatgggtttagttattttattgttttgttaagagtttaaaattgatatagttgttattagaagtttttattatttttttttttttaagtaaagaatagtggaaataattattgattgggtggtgtgtaggagagtttggttttttttttggttatttgtagaaggtaagttaaatttttataggttttataggttaatttttatattgaaagtttttgtttttttttatttgtttgtttttaaagtttttatattgaatattttgataggagattataagaattacgttagggttgagaaaaaaaattttgttaggagatatttaatataaataaattgataggttaagaaagtatggtgaaatgagtattagacgaggatttatttatagttattttgtaagttgtagaatgatataaattttttatttgtagtttgggaaattgaggtgtagagagagtgaaaatattggttagttttattttttttttagagttttttaagatttaaatgaaatgttagatgtggaaataatttatttttatgttatttaatagtttttaggttattattattgggtttgtaattgtatgttatgatttaaaatttttttttaggtattgtaattttttaaatttagttaaatttatttgaataaatttagttttttagattttgttatagttatatttaaatttgtggtattttttttgtatgtatagatgtgttttatatttatttgatattttattagttgttttatgattttatttttagtttgtttatagtaaataaaagtatatttatttataaagtttttatttgtttttataaatttttgttgattaaatgttggtgaaagttttatagagataattagtttatagtaaggaattaaataaatagttataggaagtatttttttaaggatttaagttttattttattaaggtagaagattaattaaattagttgttttgtttttagttgagatgagtatttgttattttagagttaaaaaataaaagaaataagtaagtaataaatatagttttgggttgtttgtgtatgggggaaaatgattttcgaaattttatagtaattgtttagttttaaggtaaaatatttgattataataattattttaatatttattagtaattgtaaaattaggtattagtaatttattaagttatagtatttaaaattaggattttaggaggttgttttgtttgtatatttttaaagaatttaatttttttcgtttattttaaatgtagatttttattttttgtttttataaaattttagaagtttttatttttaaaatttttttatatttaaaaaaattatgagattggttataaatagaagaatggataaaatgataagaattatttatttattaaattttgttatgtgatgttttttgtagattatatttatattttttttgattattaattatgatttagtttaaagaatgttgtaggtttagtatagttttttatatttataattaattttttaattttttttaaatttttattttaattttaattttatttatgaaatatgtatattttggatagtaaattaaaatttattttttatattaaatttaatattaatttttttttaagagttgtagtttttttttttttggtgtttaggaggtaaaattttggttgttttttagtggttgtttgttttttttaggtattatattaagttttttgaaattttaagtaaattatatttgttttgttagtttttttaaagtatttaaaatgattttaacgttttgattttttttaaatgggattagtaattatttgatttgataaaattagatgttttattagtttttttggaattgaagataagtttaattgtttttaatgttagagagttttgagttttaattttaatttataatatgaatatgaaaatatgaaaaaagaaagttgtaaaaggaagttaaggaagattgtatttgcggaagggtttttgattattttagtaattgttgaattgtgggggggggggtgggtgggtggtataatgaatttattatttattattaatttataattaaattgattttgaaattagattttagtagttaaaattaaaggcgataaattgatgttattgttattttaggattttttattttttataaagttatataaatatttgattaatgggattattttttaattgagttagttttaatttttaggttaagattatttaaaatttattatacgttattaatattatataggtggatagtattttttgttagttaaaatgtggttaatttgtaaattataaatatagtttttataattttttgtttttaggtttttaaataattttaaggttttgtgtaagggttttgaattttaggtttaggtttattattttagtttatgaggtgaattaagttttgtatgtttttttagatgttggaagaaaataatttattcgtggttgtgtagaaatttatagttttatatgtttatttttaattaaaatatatttataaagtatgtgtatgttgttaattttttagttttaatttttttgtttttttaagtggatgttttgaaaataataattatttattttgttatttattgttttgtaaaatataaggtagaggtttaggaataggggttttattaggagtagtgttgttttttttaaaattttattttattttaggttgttattatagatagtaaaatatatttatgtggtttaagtgtgatttaattttgtaaattatattgggttttggaatggtttaaaggtttttatggtttattatatttatttttgtttatataaattggtaagaatttattgtattttggttttgagttttttttaagttttttttatttatagttatttttattaaagatatatttttatattaaagatttttggatagtattaataaggaaaaggaaggaataatagtttattatattttatatttttttgtttttaataagtataagaaaaagtagttatttttttttgagttggtagtttagaatttttaggaatgtagtgttttggaagatggaagaatttataattagttgtttttaagagaaattttagataaagtattgtattattttgtttatttgtttttggtgtattttattttagttataggtaaagtagaaaattaggtagggtttgagtttttttgtttattatattttaaaagttaatttaaaggtaatttttaaaagatgaattaaaaatgaagtgtattaaaattttaatttacgttttataaacgttaaaatgagaaatgttttacgagggagacgtgatgtaataatatatgagttgggtttggttttagacggtttaaggtttattataagttgtagagttttggtttgaagaaataaagatagttatttttaaatttcggtttttttaaaatggtattgtatttcgtatagttgtcgagaatttaaattttatattttatgtatattagtttgtttataattagttattttgagaaattttgtttttttggtttagatagaatgaaagaaattgagtttggattttgttttgtatatgaattagaatttgtgtgttttaagttgtttttttagggtatattatggtaaagagtagggagtttagtttgattgtgtaggttcggttggattattttaagcgtattatttatttttttagtgaagtgagggagttagattaaaatattttttgatattttttttagttttaaaattttacgtaatttacgggggaagaaatttaagaaattttgtatatattaaaatattaaaaattttattttttttaaaaatggtttataacgaatagattattatttttgatattttaggttttgtagtttatagtttatagtacggaggaatgggttaagttatattatagtaggtttttttttacgtttaatagagggggcggggggtttttttggaagattcggttagtgttaggtagtaaggggtaagggttgtttcggtggagaaagaaatttaggttttcgggaatataaattgggggatgtaggggtaaagtatttgttaaatttcgttagggttgggattttaaagagggttgggtttgttttgagaaatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatggttatcgggtttattaataaagtgtttaataggtcggtgatagttagtttatatattagcgtgtagaaggtcgtttttttttgttttttgcgcgatttgtatagtattacgatggttattaggttgtttattatttcgaagatgaatattatcgtcgggatggttattgggttgtttagtcggtcggggtttaaggaggcggacgaattgatttcgggagtggatatgatagtggttggcggtgcgtagttttggagtgtaaggttgggtttggggatggtagaagagagataaagttgtcgtgagcggaaattattatttgtaaggtgttagattcgcgttcgagaaacgatatattgataagataaggggagtaattcgattttattttttggattgtagttatttattaattgcggttattaaaatttttaggttcgcgatacgttttgttaatagtatatttttgttgatattaatatttataaattgatttttttatttttttttttttttataatttaatttattttattgttaagatgaataagatttattttaagggaaaagtagttcgttagtgttattttcgatagattttgaattaataaaatgtttattgaaaataagttataaaagtaatttggagagcgcgtttttttttttttggtttttttcggcgagggtcgtatttttgcgttttttattcgttgattttaacgttagtttaacgttattttatttgtagcggtagtagcggtggtagttttacgagtttttagggttagtttttagatgttttggattcgtttttaatttgtttttattttgttttgtttagtttggaaattgttaaattttcggttttttaaagtcggttttagtggttgtcgatttttggatatcgaggttagagttgttagtttttaaaaatttgggaaataagaggtgtagcgggatgggttagtgaagaatggtgttggattttttattcgttatttttttttttttaaagacgagttttagttttgtagtgttcgtcggtttcgtttgcgggaggatagcgtttaggtgtgaggttgtgcgcgtaggtggcgcggagttttggtttttagttttggttgtttttcgttttagttacgggtagtacgggcggttattggagtttgcggttgtcgttgaggtcgtttttggttatttgggggcggttcggggtttattttgttagaggttttggtttggggttgtttatttttttttcgggttgtcgggtttggagtttcgttttcgtttttttattttttgtataaatttttttttttttttaagtttttttggcggaggcggaggtaaatcgcgcgttgttcgggcgtttattggtcggattggaagggggcggagcgcgttttttttgggcgtcgtagggaagattggcggggggcggtgtttgggttggggcggggttgggcgcgcggggtggggcggttttcgtggtttttacgttttcggaggtgcggagtgggaattcggaggggattttgggaagtttcggtgtttttttcggcgatcgtttagtcgtttttgaattcggtttttagtggggttattattgaaatcggcgatcgttttcgtttcgttgtttgtcgttcggagtgtattattttttgaattttttgttcgcgggtcgtaatatttagatcgtggaagagagggtagttgttttaggattttatttagggttggtcgagaaaggagaagaaatacggtgtttgcgttagcgcgtgcgtttcggggttagatttgggtgcgtttagcggacgtggtaggtgggtgggtgggtgggtattagattgggcggggaaataacgaagaatttatttttttattataaaaggagttggagttagttggtagtgtttagattgcgggttgcgtttggtcgggtattttaggtaaaaaagaaaaaaaaaaaagagaaagaaagaggaggagatagtgattgtagtttttttcggcgtaggtggtagagttttgcggttttggagagaggtggagttttggtgaggttgggaggattgtttaattgcgatttttttttttatttttttttttgggaattttttcgttttgaaagggtagcgtgagttttatgttttcggtcggtcgtgttatattcgttagatttaatttattatgaattttttgaaagattagtggagagtgagaagggggttttaaagttattggagtaaaggaattttttaagtattattttatgattaatttttggaaaagtttgtttgcgcggtttttagaattattttgattttttgtttaatggtgaagtttttttttgtaatttttttattttgttttttaaaattagaattaaaaatttaaaaaattgtaaaattttatggtgtaattaaaatttttttattattttttttaagtaagattgtgtggttttattgtataatttaaatttttggaaaaatttttttttatttgtagtgtataagtattttaatatattatgtttttttatagggtaagtaaataattggatttttttatgtgataagtaggtatttattttttaaatgttatttcgtgaacgaataaattttttaattggttttttagttagttttagtaatatatgggtaataagagaaattaaaagggtttttcgattttaagtaattataggttataaaatatttagaattatatttatttgtaaaaggtattatatggatatattaataaagaattattttgtttatattatttatttaataatatgagaaagaaaaatatatatttgttagttaatattaagattgatggtgattggttatttttttaaaaatttttttttaattagtattttaattatttttgttgtcgatgttttttttgaatagtaatttttaggattgtgttagtatagaaaataaattaatattagaaaaaaggaaattgtatattttgcgttattttttattaattatattgttttgttattatttatgttagttgtttgttagtaaatatatggaggggaggttgggaagttttttatatttattttttgttaatataaatttttttttttaattttttttttatatgaagtttgtaaaagagaaaataattggttgttatttattaatttaagaatgatgaagaatatattaaatataaaaattgagatatattgttgagataattagtaattgttataggtattagtatgttattgataaattagatttgttattaattgagttattttttttattagttttttgaattttttttttatagtagttttaggaagaaggaaaataaataatttaatgtttaatattaaaaaattgtaatgaggtttatttgtagttttttttgttgtacgatttttaaaatttaaatttagtttttaaaagtagaagttgaaagtttaggtagtaaattattttatttttttagtttgaaaaattgggatagtggagtttagttttttttatattttgttaggaatttgtattgtaaaaggaaaggaaaaattgttataattatgtgggtaatttttgttatttttttttaatgaaaagatttttattttaagtattttaaaaattttttttcgtagtttttgttataatttttatttttttatgttggaagattttagtttagttatttaaaattgttattaaataattttttgaaggtttgaattattttaagaattgtttgattagtttgattgttttgttatagttaattatttgacgagttttttgagtaaatatattaaggtgggaatttatttataaataaaggtcgtttgggagttagtaattatttttagttttttttggattaaaggaaatatgggatagataggatttgggtttagttagtaggagtggggtgagaaaggggattatttttaggaggaaggtagtaggatgagttagatttggtttggatttttttttgagtcgtagttggtaggattttagagtatttttgaagtattaatatttatgtagtaaagtttgtgtaaattgtgtttgttttttttttttatgataggttatgtagagatttaaaatagtgtgaaaggtatttattaggtataaatagtaaagtatttttggatatatttgttttttataggtttttttagttggtttagtggattataaatatggtatttatttgattttaagatgattgttttttttttttagtggtatattttaaatgtgtgtttttttaattatttttattttttaagtatgaagtttatgttgagtttaatgtttggagttgatatatgttagtgttgtgattaattttttaatatttttatgtggtgataaattattgttgtggaggttggtttttattgagtgattgttttaggttgttttgatagtttgttttgataattatattttttaaagtaatagttttttgtttttttattttgttcgttttttttttttttttttagttttattatacgtttatgtggattggattaatgggtaaagaaaggagattatttatttgtagtggttttttttttttttttttttgagatagattttcgttttgtcgtttaggttggagtgtagtggtgtaatttggtttattgtaattttcgttttttggatttaagtaatttttttgttttagtttttttagtagttgagattataggtatgtgttattttgtttggttaattttgtatttttagtagagatggggttttattatattggttaggttggtttcgaatttttgattttgtgatttatttttttcggttttttaaagtgttgggattataggcgtgagttatcgtttttagagtggtttatttttgaagatataagtggagaaataaagttttattagttaaagagttttttttataggaggaaggattttttgattatatttcggtttttttttatatttaaattgttgtatgttttagtaatgtggaggatgtatagaaattttttggtttaattaatagtagtagtattatttgtagtttatgttagtttattattttttatagtagttttatatttggcgtttatatgcgtttttattagtaattttttgaggaggttaggtaggtgtgatagagtttgttgtgttgtattaaattttgtttttattttttttggaatatatagttgcgtattattttttaaattgattttttgtggttaggtgtagtttatgtgattgaattttggttaatggaatagaggtagaattgatatatgttatttttaggttgggtttttataaaatttagttttttgtgttattgttcgttttttgttaatataatataggtttcgggtatatggtagagttattagatagaaggtgatttggtttttgagtgtttgtatggattttattttaattttagtaatttttattggataatgaagtgaatgagaaataatgtattgagatttgaggggttttttgttttagtagttagtttatgttgattaatttagtatggttgatgtaatttttttttagtgagtgagaatgtgggtatagagattttatgtggtttgttgagagttataagaattagtaagaatagttgaaatttatttaatgtttagtttatgtgagatattatgttaattgtaatatgtatacgttgttaaatttttatagtaaatttatgaggaaggtattaggtagttagatgtttattttatagatgagtaaattaaagtttggttaacgaatgttgggagtgtttttttttttttttttttttgtggtagggttttaatttgttttttagattggagtgtagtggggcgattttggtttattgtaatttttattttttggggtttagtgaattttagttttttaagtaagtcgggattataggtaggtgttattatgtttggttaatttttgtatttttttgtggagatggagttattttatgttgtttaggttggtttcgaatttttgggtttaggcgatttataagtttttattttataaagcgatgggattataggggttagttattatatttagtttaggtgttgttagttttgaaaggttgtttagtagttgaattttttttttattagtaagaattttttattgtataatattatttggaggtaagatttagtttgttatgagagaagttaaatgggttggattttttttttttattttttgttacggtttgagtatatgatttttgtttgatttattagatattattgtttagaaatttaattttgaaggagtggcgtaaagacgtaagagtaattttagaagttatttatagtagtagtatgtttggggtttgtggtgttaagggttttgtagtgataatggttgttggttgaggtatgttaattattatttggttaggatggtgtgattatgtttgaattttttgttggtagtttttttgttgattttttgtgtaattggttgtttttttaataaattatttttttgtttatattaattatgtttagtttttgttgtttgtaaataataagtttatttaggatagagaaattgagtaaattttttaagattatagttttgataaatggtagagtaaagattttaatttaggtttttttgatttttaaatttgtatttttaatttttatgtattt

SEQ ID NO: 56 - DNA, 14238 bp, Homo sapiens
aaaacaactgccctctcttccacgatctagatgttgcggcccgcggacaggaggttcaagaaatagtacactccgagcggcaggcagcgaggcggaaacggtcgccggtttcagtggtggccccactggaagccgagttcaggagcggctaagcggtcgccggggaaagcaccggggcttcccagggtcccctccgagttcccactccgcacctccgagggcgtgaaaaccacgggagccgccccaccccgcgcgcccagccccgccccagcccagacaccgccccccgccagtcttccctgcggcgcccagggaggacgcgctccgcccccttccaatccggccaatgggcgcccgggcagcgcgcggtttgcctccgcctccgccagggaaacttggaggaggagaaaagtttgtacagagggtggaaaggcgagagcggagctccaagcccggcagcccgagaggaagatgaacagccccaggccagagcctctggcagagtggaccccgagccgcccccaggtagccaggagcggcctcagcggcagccgcaaactccagtagccgcccgtgctgcccgtggctggggcggagggcagccagagctggggaccaaggctccgcgccacctgcgcgcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacaggtgagatggcgttgggctgacgttggggtcaacgggtagagaacgcagggatgcggccctcgccgaagagagccaagaagggaagagcgcgctctccaaattgcttttgtaacttgttttcagtgagcattttattgattcagaatctatcgagaatagcactagcgagctacttttcccttgagatgggtcttattcatcttggcaatggagtgagttggattgtggggaggaagaggaatgggaaaatcagtttataaatattaatgtcagcaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgcaaaacctgaaatgtcagggatggtgatctgttcgttgtaaaccatttttaaggaaagtggggtttttggtgttttgatgtatgcaaggtttcttgaatttcttcccccgtggattgcgtagaattttaaagctagaagagatatcaagaggtgttttagtctaactccctcacttcactgagggagtgaatgatacgcttaaaataatccagccgaacctacacagtcaagctaggctccctgctctttaccatggtgtgccctgggagggcagcttaaagcacacaaattctaattcatatacagggcagggtccagactcagtttctttcattctgtctagaccaggaaagcaaagtttctcagggtgactaattatggacaggctgatatacatagggtatgggatttgaattctcgacaactgtgcgaggtacagtaccattttagagaaaccgaggtttagagatggctgtctttgtttcttcaagccaaagctctacagcttgtaatggaccttaggccgtctgaggccagacccagctcatgtgttattacatcacgtctccctcgtagaacatttctcattttggcgtttgtaaagcgtgggttggagttttggtacacttcatttttagttcatcttttaagaattgcctttggattaacttttaaaatatgataaacagaaaggctcaaaccctacctagttttctactttgcctgtggctaaaatggaatgcaccagaagcagatgggcagaataatgcaatactttatctagagtttctcttgaaagcaactagttatgagttcttccatcttccaaaacactgcattcctggaaattctaaactaccaactcaaaaagagataactgctttttcttatgcttgttgggaacaagagaatataaaatgtaatgggctattattccttccttttccttattgatactgtccagggatctttggtgtaaaaatatatctttgataaaagtgactgtaaatggaaggaacttagagggggctcagagccagaatacagtaggttcttaccaatttgtataaacagaagtaaatataataggccataagagcctttaagccattccaggacccaatataatttacagagttaagtcacacttgagccacataaatatattttactgtctgtaatggcaacctagaataaagtgagattttggaagaaacaacactgctcctgatggggcccctgttcctgggcctctgccttgtgttttacagaacagtaaatgacaaagtgaatggttgttattttcagaacatccacttaaagggacagaggaattagagctagaaggttagcaacatgcacatactttataaatgtgttttggttggaagtaagcatgtaaagctatggatttctgcacagccacggatgaattattttcttccaacatctagagagacatacaaggcttaattcacctcataggctgaagtggtagacctggacctaagattcagggcccttacacaaagccttgaaattatttgaggacctagaggcaagaaattataggagctgtatttgtggtttgcagattaaccacattttaactaacaagaaatactgtccacctgtataatgttagtaacgtgtagtaaattttaagtaatcttgacctgaaaattgaaactagctcaattaagaagtaatcccattagtcaagtatttatatagctttgtgagaaataaggaatcctaaaatagcagtggcatcagtttgtcgcctttagttttggctactaaagtctaatttcagaatcagtttaattataaattagtgataaatgatgggttcattatgccacccacccacccccccccccacaattcagcaattactgaaataatcaaaaacccttccgcaaatacagtcttccttggcttccttttacaactttcttttttcatgttttcatattcatgttgtaaattaagattaaagctcagaactctctgacattgaaagcagttgagcttatcttcagttccaaagaaactaatgaagcatctaattttatcaaatcaagtggttgctaatcccatttaaggaaaatcaaagcgttggaatcattttaaatgctttggaaaggctaacaaagcaaatgtagtttacttggaatttcagaaagcttgatataatacctaaggaaaacaagcagccactgaaaagcagccaaggttttgcctcctggacaccagggaagaaagagctacagctcttagaggggggttggtattgagtttagtataaaaaataaattttaatttgctatccaaaatatacatatttcataaatagagttaagattggagtggaaatttgagaaaggttgggaaattagttgtggatataaggaactgtgctgaacctgcagcattctttgaactgggtcataattaatgatcagagaaggtgtaagtatgatctacaaggaacatcacatgacaagatttagtgggtaggtggttcttgtcattttgtccattcttctatttataaccagtctcatagtttttttaaatataggagaattttggaagtgagaacttctaaaattttgtgagaacaagaagtgagagtctacatttaagataaacgaaaaggattgaattctttagaaatatgcaagcaagacagcctcctaaggtcctggttttaaatgctgtagcttgatgaattactagtgcctaattttgcagttactaatgaatattaagatgattattataatcaaatattttgccttagggctaaacagttactatagggtttcgaaggtcattttcccccatacacaagcaacccaagactgtatttattgcttacttgtttcttttattttttaactctgaagtaacaaatactcatctcagctaggggcagaacagctaatttgattaatcttctgccttggtgaggtaaaacttaggtccttaggaaaatacttcctgtgactgtttatttggttccttactataaactagttgtctctataaagctttcaccagcatttgatcagcaaaagtttataaggacagataaaaactttgtaaatagatatgcttttgtttactgtaggcaaactggaagtggagtcataaaacaactgatgggatgtcagatgagtgtgaagcacatctatacatacaagagaaatgccacaaatttgggtatgactatgacagaatctaaaagactggatttgttcaaataaatttggctaagtttaaaaaattgcaatgcctagaaggaagttttaaatcataacatgcaattgcagacccagtagtagtaacctgaagactattgagtaacataaaagtaagttatttccacatctggcatttcatttgaatcttgaaaagctctaaggagaaagtagggctgaccagtattttcactctctctacacctcagtttcccaagctgcaaatgaagaatttatatcattctgcaacttacagggtagctataggtgagtcctcgtctaatgctcatttcaccatgctttcttgacctgtcaatttgtttgtattgaatatctcctaacaagattttttttctcagccctgacgtgattcttgtagtctcctatcagaatattcaatgtgagagctttaaaaacaaacaaataaaaaaaaacagaaactttcagtgtagaggttgacctataaagcctgtagagatttaacttgccttctacaaatggccagaagaagaaccaagctctcctacacaccacccagtcaataattatttccactattctttacttgaaaaaaagaaagtgataagaacttctagtaacagctgtgtcaattttggactcttaacaaggcagtgggataactgagcccatacagataattccttttatgtgcttggaacagaacaagtagcacacacattcaaatccagctacagatcttgtcacttattggaaagcgttactgttttgacagtccattactaaatctaatcaagagttcaacattctttcttcaacattccctgcaaacaaattattaagtaggaagtacatgtttttgataccatattattaactatatcccaaagctacctctaagctacagttttcaaattattgataccttccacactgggcaagcttccacatatgggttgaaagaaaaagtaatgagagccaacatatctgttatacgataggcactgtactaagcactttaataatttgtacatacgttataagggcagagccaggatttgaacagaggcttgtttgcttccaaagcttgggcatttatctctacagcatatagcctccttacagctttcttgtcaccacatcttcttctgaacttattgcatttcctcaaagttatgttccactgctcctgagccctaatctctaatcatcctaaaaaaaagtgtgaataacataatttaaaaaaaattaggtgggtgtggtaacatgtgcctgtggtcccagcaacttggaaggttgaggctggaggattgcttgagcccaggaggttgaggctgcaatgagccatgtttgtatcacagcactccagcctgggtgacagagtgagaccctttctaaaagaaaataaaataatttagaatactgtaatatgccaatattaacaacaaaccacatgtacacagcaggagctactagaaaaagacttaaaattggaagaaaggagatacgttgtttgtattcagtgagtttttttgtttttgtttttgtttttgtttttgttttgagacggagtttcactttgtggcccaggctggagtgcaatggcgcaatctcagctcaccgcaacctccacctcccgggttcaagtgattctcctgcctcagccttccaagtagctgggattataggcatgcaccaccacgcccggctaattttgtatttttggtagagactgggtttctccatgttagtcaggctggtctcaaactcctgacctcaggtgatccgcctgcctcagcctcccaaagtgctgggattacaggcatgagccaccatgcccggccatattccctcctgactcggaggttcagttttatcagcaacacactcttccaacactgaaaactgcctgaacttgtttaattatgtaaaatatagggcctgttggacaagaattccgaaaagtgctttcaccccctcacgagacattgaagcactactccggatgtccccatctcaactggggttgtccctgccctcttggaaacagcaaatcaagtagcctacttaaagtgaagcagaggttgctctatgttttcaaacattgcaagatgcgtggagtttttgtttgttttgtcttttttctttccctacttgaagtaagtctcaattgaaatacgctgcaaagtaaaactcatattgattcttttcaatctaaccaacttttgaggatgtttttacctgaatttggacttttgctttttaaactcatacttttactaccctgtgaactcccctttattgaaaagacattgaatgaccaggttcagtggcttgtactaattgtaaacttttcctcccccatggaaaactttaaaatagagcatacttttaatatagcctcctttcattccctcctatactagtcgaaatccattgctgctgtggatgagatgaggcacagaaatgattctttccttgcctctcatcacctttgattatgaaaacctattattaattgttttacaacattccaacctttctaaaaggccacagaaattttaaaatgctaactcctaatgtacttctttgaatggctataaattccattttaactattcaaaaattttcttcctttcagtagtagccatgtttcctttgaggttgtggtaggagaagcaaccagcaataaaacattttcagtgtcaaaaatctcagaaacgtcaggttcagacttaaccaaaattctgttctgcgagtctcggagatggctttacacagtgcttgttagggaggtagtatcagaaactctcaagtggagcaacactgccacctggaggcttgaaggctcaagttcgcataaacccggccgtaggtcttttccagagaccacacacaggacttgatactaacagatttaacgccatcatttcttctacccttaggaacgtagtatgtgatgtgaataaaatatagacctcatgctttttaccaacaattccattgtcaggaaataataattaaacagaaagccagactggtagaacagaaaaggcaacatggaggtccagaccagactctgccaccaacagggtgggggacatcctaagttcctcaaaacctctgggtctcagtaacaaatacctcatctgagaaaaggcctgtagagttgagggaactgctgagtttccaggcatagctgaagacctcaaagcttatggaaggaagaaaccaagatgctttattttactttctgtaaagatttttttttaaatcaagtatgctttgccttgatactatcatttatcccagcgtagtttctaaaagtatttcaagaggcgatattacacactgctgttcattctagttcattcttgatttagctgtcttccatataggaagatattaatttcatcttggttagaggcatgtcactattttattctctgagatttacaggcccataatcccatatccaaaatatttacgggcagatgagtttcagaattcagaatttcttggcttttagaaaagtaatcaataatatattgcaaaatatgtaatatccccatcagaactggaacagtaatcctggaccagaacataggaatattcactctaagtggaataaattgaactaaatggcttcacagtctgttcagttcagttttgctgccaaaataagtttaggtcagattttgcaatgagtgtaagttctcaaaacaaaacaagtgaataacaacaaaacaataacaaaggaaatgaacaaaaatcttttgagagaggatcagagacctatagctaattaagatctaaattccagttaaggaagaaaaagaaatgcagttctaccttactgatccagtatcatccaggagtaagtttaatataagcttgattttgcagattaatgaaatgtatttcttcgaatattttaaagattcaaagaatctttaaaggaagaaaaaaataattcttccttcttttacccaaattttacccaaattgttgaaaatctttctataatatcctgacccaaatattgttacatctagtaagtgccaaaggaacacatgcaaatggtcaatgaatcgccttttccgttgtgaactgactcagcctcaactaaactgtccctgttccaggtgattcatacaccatgagtcattcattgttacgctgtatatagtaaggcagcaacatcctcaagtcttgttagagatatttgcccctagttaaatggctccagctatgcttttgttagttctttctcctttttgtggtttttatgtatcttccttgactgtgagactcaacctcttctccctaacctaaaataattactaaaggcaagaaataattactaaataattacttaagatatatggcaattatttttatttctatactactatttctatttctatttctatgtgaattaccactactactatttctatattaattacagatgagatttttatataaatgatcccagtggaattagaagtaatatctaggcaaaaaaaaatcataatactttaagagtaaatttgaggctgaacatggtggctcactcctgtaattttagcactttgggagactgcagcgggcagatcacttgagctcaagagttagagaccagcctgggcaacatagaaagacctcatctctacaaaaataataacagttagccaggcatgatggcacacacctgtagtcccagctactcaggaggctacagcaggaggattgctggagcctagggggtcaaggctgcagtgagcaatgattacaccactgcactccagcctgggcgacagagtgagaccctgtctcaaaaatatatatacatgtacatttaacaaatgcattttcccctaaggattaaaatgatcatgtaagtttacacaaattcatgctccattcgctgaatcatttgaagttcccagatgttgacatatcatttcattcttccatgactttgcacatggagctacctctatttgaaatgtgatgtctttccttctaaatttagcaaattctcattcatccgttgtgattactataactggggaacagagtcatagagaaaataaaaactattctctggtcattctgggtaacaggagatcctgctgttggtgtaaaacttttcagcatattctttctagactagaataaaagaatcttggccttattctggtgattagatggttaattgacttataaaatgagtttcctttaaattatgtaaaatgacagctggaataagaaatcagtagcttttgggggaaaaaagttacttcattagaattacaaaaacttaaaagcactcacagaaatgaagttaataaagtgcttctcaagaacactttatacatatgtgacctgcactcacattgcatttttgtatactgtctttgctctagggaagataatcataagatagttacaaaaatattaaagctatacgaactcagaacatgtaattgcatttttgcagtgactggtttttatttttttattttttatttttaaacagattcttgctctgttgccctggctggagtgcagtggcatcatctcagctcactgcaacctccacccgccgcattcaagccattctcctgcctcaccctcctgagtagctgggattataggcgtgtgccgccacacctggctaatttttgtttttttgagacggagtctcgctctgtcgccaggctggagtgcagtggtgggatctcagctcactgcaacctccgcctcccaggttcaaatgattctcctgcctcagcctcccgagtagctgggactacaggcgcatgccaccacacccagctaatttttgtatttttagtagagatggggtttcaccatgttggccaggaggttctcaatctcttgacctagtgatccgcctacctcggcctaccaaaatgctgggattacaggcgtgagccaccgcacccagcctaatgtttgtatttttagtagagatggggtttcgccatgttggacaagttggtctcggactcctgacctcaagtgatcctcccacctcggcctcccaaagtgctgggattacaggcgtgagccaccgtgcccagcccatgactggtttttctgaggcttattatgtagcttcctcttttcctggaacttgttaccagaaatgaaggcagcttcctaatattgataaggtagacatagcatttatatgttttcccaattgattaatgatgaaatctaaatgtgcgatctcacttatgcaggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatcatcctacaactcacattagagaacatcctggcttttgagcacttttcaaacaatcaagttgactcacgtgggtcctgaggcctgcagcacgtcggatgctaccccactatgacagaggattgtggtcacaacttgatggctgcgaagacctaccctccgtttttctactagataggaggatggtagaagtttggctgctgtcataacatccagagctttgtcgtatttggcacacagcagaggcccagatattagaaaggctctattccaataaactatgaggactgccttatggatgatttaagtgtctcactaaagcatgaaatgtgaatttttattgttgtacatacgatttaaggtatttaaagtattttcttctctgtgagaaggtttattgttaatacaaggtataataaaattatcgcaacccctctccttccagtataaccagctgaagttgcagatgttagatatttttcataaacaagttcgagtcaaagttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaataacccataattgaagtgtataatataaaaaattttaaaaatctaagcagcttattgtttctctgaaagtgtgtgtagttttactttcctaaggaattaccaagaatatcctttaaaatttaaaaggatggcaagttgcatcagaaagctttattttgagatgtaaaaagattcccaaacgtggttacattagccattcatgtatgtcagaagtgcagaattggggcacttaatggtcaccttgtaacagttttgtgtaactcccagtgatgctgtacacatatttgaagggtctttctcaaagaaatattaagcatgttttgttgctcagtgtttttgtgaattgcttggttgtaattaaattctgagcctgatattgatatggttttaagaagcagttgtaccaagtgaaattattttggagattataataaatatatacattcaa

SEQ ID NO: 57 - DNA, 14238 bp, Artificial Sequence
  bisulfite converted genomic DNA
aaaataattgtttttttttttacgatttagatgttgcggttcgcggataggaggtttaagaaatagtatatttcgagcggtaggtagcgaggcggaaacggtcgtcggttttagtggtggttttattggaagtcgagtttaggagcggttaagcggtcgtcggggaaagtatcggggttttttagggtttttttcgagtttttatttcgtattttcgagggcgtgaaaattacgggagtcgttttatttcgcgcgtttagtttcgttttagtttagatatcgtttttcgttagttttttttgcggcgtttagggaggacgcgtttcgtttttttttaattcggttaatgggcgttcgggtagcgcgcggtttgttttcgttttcgttagggaaatttggaggaggagaaaagtttgtatagagggtggaaaggcgagagcggagttttaagttcggtagttcgagaggaagatgaatagttttaggttagagtttttggtagagtggatttcgagtcgtttttaggtagttaggagcggttttagcggtagtcgtaaattttagtagtcgttcgtgttgttcgtggttggggcggagggtagttagagttggggattaaggtttcgcgttatttgcgcgtatagttttatatttgaacgttgttttttcgtagacgagatcggcgggtattgtaaagttgggattcgtttttgaaggaaaaaaaatagcgagtaagaaatttagtattattttttattgatttatttcgttgtattttttgttttttaagtttttgaaagttggtaattttgatttcggtgtttaaaaatcgatagttattgagatcggttttgagaagtcgaagatttggtagtttttagattgagtaggataaggtgaaagtaggttggaggcgggtttaggatatttgagggttgattttgggggttcgtgaggttgttatcgttgttgtcgttataggtgagatggcgttgggttgacgttggggttaacgggtagagaacgtagggatgcggttttcgtcgaagagagttaagaagggaagagcgcgttttttaaattgtttttgtaatttgtttttagtgagtattttattgatttagaatttatcgagaatagtattagcgagttattttttttttgagatgggttttatttattttggtaatggagtgagttggattgtggggaggaagaggaatgggaaaattagtttataaatattaatgttagtaagagtgtgttgttggtaggacgtatcgcgagtttggagattttggtggtcgtagttggtaagtggttataatttagaaagtaggatcgagttgttttttttgttttattagtgtatcgtttttcgggcgcgggtttaatattttataagtggtaattttcgtttacggtagttttgttttttttttattatttttagatttagttttgtattttaaggttgcgtatcgttagttattattatgtttattttcggggttaattcgttcgtttttttgagtttcgatcggttgaatagtttagtgattatttcggcggtgatgtttattttcggggtggtgggtaatttggtggttatcgtggtgttgtgtaagtcgcgtaaggagtagaaggagacgattttttatacgttggtatgtgggttggttgttatcgatttgttgggtattttgttggtgagttcggtgattatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgttttttagagtaggtttaattttttttgaagttttaattttaacgagatttagtaggtgttttgtttttatattttttagtttatgttttcggaagtttgggtttttttttttatcgagatagtttttattttttgttgtttgatattggtcgagttttttaagaaaatttttcgttttttttgttagacgtggaggggagtttgttgtagtgtgatttagtttattttttcgtattgtgaattgtgaattgtaaaatttgaaatgttagggatggtgatttgttcgttgtaaattatttttaaggaaagtggggtttttggtgttttgatgtatgtaaggttttttgaattttttttttcgtggattgcgtagaattttaaagttagaagagatattaagaggtgttttagtttaatttttttattttattgagggagtgaatgatacgtttaaaataatttagtcgaatttatatagttaagttaggttttttgttttttattatggtgtgttttgggagggtagtttaaagtatataaattttaatttatatatagggtagggtttagatttagttttttttattttgtttagattaggaaagtaaagttttttagggtgattaattatggataggttgatatatatagggtatgggatttgaattttcgataattgtgcgaggtatagtattattttagagaaatcgaggtttagagatggttgtttttgtttttttaagttaaagttttatagtttgtaatggattttaggtcgtttgaggttagatttagtttatgtgttattatattacgtttttttcgtagaatattttttattttggcgtttgtaaagcgtgggttggagttttggtatattttatttttagtttattttttaagaattgtttttggattaatttttaaaatatgataaatagaaaggtttaaattttatttagttttttattttgtttgtggttaaaatggaatgtattagaagtagatgggtagaataatgtaatattttatttagagttttttttgaaagtaattagttatgagtttttttattttttaaaatattgtatttttggaaattttaaattattaatttaaaaagagataattgtttttttttatgtttgttgggaataagagaatataaaatgtaatgggttattattttttttttttttttattgatattgtttagggatttttggtgtaaaaatatatttttgataaaagtgattgtaaatggaaggaatttagagggggtttagagttagaatatagtaggtttttattaatttgtataaatagaagtaaatataataggttataagagtttttaagttattttaggatttaatataatttatagagttaagttatatttgagttatataaatatattttattgtttgtaatggtaatttagaataaagtgagattttggaagaaataatattgtttttgatggggtttttgtttttgggtttttgttttgtgttttatagaatagtaaatgataaagtgaatggttgttatttttagaatatttatttaaagggatagaggaattagagttagaaggttagtaatatgtatatattttataaatgtgttttggttggaagtaagtatgtaaagttatggatttttgtatagttacggatgaattatttttttttaatatttagagagatatataaggtttaatttattttataggttgaagtggtagatttggatttaagatttagggtttttatataaagttttgaaattatttgaggatttagaggtaagaaattataggagttgtatttgtggtttgtagattaattatattttaattaataagaaatattgtttatttgtataatgttagtaacgtgtagtaaattttaagtaattttgatttgaaaattgaaattagtttaattaagaagtaattttattagttaagtatttatatagttttgtgagaaataaggaattttaaaatagtagtggtattagtttgtcgtttttagttttggttattaaagtttaattttagaattagtttaattataaattagtgataaatgatgggtttattatgttatttatttatttttttttttataatttagtaattattgaaataattaaaaattttttcgtaaatatagttttttttggtttttttttataattttttttttttatgtttttatatttatgttgtaaattaagattaaagtttagaattttttgatattgaaagtagttgagtttatttttagttttaaagaaattaatgaagtatttaattttattaaattaagtggttgttaattttatttaaggaaaattaaagcgttggaattattttaaatgttttggaaaggttaataaagtaaatgtagtttatttggaattttagaaagtttgatataatatttaaggaaaataagtagttattgaaaagtagttaaggttttgttttttggatattagggaagaaagagttatagtttttagaggggggttggtattgagtttagtataaaaaataaattttaatttgttatttaaaatatatatattttataaatagagttaagattggagtggaaatttgagaaaggttgggaaattagttgtggatataaggaattgtgttgaatttgtagtattttttgaattgggttataattaatgattagagaaggtgtaagtatgatttataaggaatattatatgataagatttagtgggtaggtggtttttgttattttgtttatttttttatttataattagttttatagtttttttaaatataggagaattttggaagtgagaatttttaaaattttgtgagaataagaagtgagagtttatatttaagataaacgaaaaggattgaattttttagaaatatgtaagtaagatagttttttaaggttttggttttaaatgttgtagtttgatgaattattagtgtttaattttgtagttattaatgaatattaagatgattattataattaaatattttgttttagggttaaatagttattatagggtttcgaaggttatttttttttatatataagtaatttaagattgtatttattgtttatttgttttttttattttttaattttgaagtaataaatatttattttagttaggggtagaatagttaatttgattaattttttgttttggtgaggtaaaatttaggtttttaggaaaatattttttgtgattgtttatttggttttttattataaattagttgtttttataaagtttttattagtatttgattagtaaaagtttataaggatagataaaaattttgtaaatagatatgtttttgtttattgtaggtaaattggaagtggagttataaaataattgatgggatgttagatgagtgtgaagtatatttatatatataagagaaatgttataaatttgggtatgattatgatagaatttaaaagattggatttgtttaaataaatttggttaagtttaaaaaattgtaatgtttagaaggaagttttaaattataatatgtaattgtagatttagtagtagtaatttgaagattattgagtaatataaaagtaagttatttttatatttggtattttatttgaattttgaaaagttttaaggagaaagtagggttgattagtatttttattttttttatattttagttttttaagttgtaaatgaagaatttatattattttgtaatttatagggtagttataggtgagttttcgtttaatgtttattttattatgtttttttgatttgttaatttgtttgtattgaatattttttaataagatttttttttttagttttgacgtgatttttgtagttttttattagaatatttaatgtgagagttttaaaaataaataaataaaaaaaaatagaaatttttagtgtagaggttgatttataaagtttgtagagatttaatttgttttttataaatggttagaagaagaattaagtttttttatatattatttagttaataattatttttattattttttatttgaaaaaaagaaagtgataagaatttttagtaatagttgtgttaattttggatttttaataaggtagtgggataattgagtttatatagataattttttttatgtgtttggaatagaataagtagtatatatatttaaatttagttatagattttgttatttattggaaagcgttattgttttgatagtttattattaaatttaattaagagtttaatattttttttttaatattttttgtaaataaattattaagtaggaagtatatgtttttgatattatattattaattatattttaaagttatttttaagttatagtttttaaattattgatattttttatattgggtaagtttttatatatgggttgaaagaaaaagtaatgagagttaatatatttgttatacgataggtattgtattaagtattttaataatttgtatatacgttataagggtagagttaggatttgaatagaggtttgtttgtttttaaagtttgggtatttatttttatagtatatagtttttttatagtttttttgttattatatttttttttgaatttattgtatttttttaaagttatgttttattgtttttgagttttaatttttaattattttaaaaaaaagtgtgaataatataatttaaaaaaaattaggtgggtgtggtaatatgtgtttgtggttttagtaatttggaaggttgaggttggaggattgtttgagtttaggaggttgaggttgtaatgagttatgtttgtattatagtattttagtttgggtgatagagtgagattttttttaaaagaaaataaaataatttagaatattgtaatatgttaatattaataataaattatatgtatatagtaggagttattagaaaaagatttaaaattggaagaaaggagatacgttgtttgtatttagtgagtttttttgtttttgtttttgtttttgtttttgttttgagacggagttttattttgtggtttaggttggagtgtaatggcgtaattttagtttatcgtaatttttatttttcgggtttaagtgatttttttgttttagttttttaagtagttgggattataggtatgtattattacgttcggttaattttgtatttttggtagagattgggtttttttatgttagttaggttggttttaaatttttgattttaggtgattcgtttgttttagttttttaaagtgttgggattataggtatgagttattatgttcggttatatttttttttgattcggaggtttagttttattagtaatatatttttttaatattgaaaattgtttgaatttgtttaattatgtaaaatatagggtttgttggataagaatttcgaaaagtgtttttatttttttacgagatattgaagtattatttcggatgtttttattttaattggggttgtttttgtttttttggaaatagtaaattaagtagtttatttaaagtgaagtagaggttgttttatgtttttaaatattgtaagatgcgtggagtttttgtttgttttgttttttttttttttttatttgaagtaagttttaattgaaatacgttgtaaagtaaaatttatattgattttttttaatttaattaatttttgaggatgtttttatttgaatttggatttttgttttttaaatttatatttttattattttgtgaatttttttttattgaaaagatattgaatgattaggtttagtggtttgtattaattgtaaatttttttttttttatggaaaattttaaaatagagtatatttttaatatagtttttttttatttttttttatattagtcgaaatttattgttgttgtggatgagatgaggtatagaaatgattttttttttgttttttattatttttgattatgaaaatttattattaattgttttataatattttaatttttttaaaaggttatagaaattttaaaatgttaatttttaatgtatttttttgaatggttataaattttattttaattatttaaaaatttttttttttttagtagtagttatgttttttttgaggttgtggtaggagaagtaattagtaataaaatatttttagtgttaaaaattttagaaacgttaggtttagatttaattaaaattttgttttgcgagtttcggagatggttttatatagtgtttgttagggaggtagtattagaaatttttaagtggagtaatattgttatttggaggtttgaaggtttaagttcgtataaattcggtcgtaggttttttttagagattatatataggatttgatattaatagatttaacgttattattttttttatttttaggaacgtagtatgtgatgtgaataaaatatagattttatgttttttattaataattttattgttaggaaataataattaaatagaaagttagattggtagaatagaaaaggtaatatggaggtttagattagattttgttattaatagggtgggggatattttaagttttttaaaatttttgggttttagtaataaatattttatttgagaaaaggtttgtagagttgagggaattgttgagtttttaggtatagttgaagattttaaagtttatggaaggaagaaattaagatgttttattttattttttgtaaagatttttttttaaattaagtatgttttgttttgatattattatttattttagcgtagtttttaaaagtattttaagaggcgatattatatattgttgtttattttagtttatttttgatttagttgttttttatataggaagatattaattttattttggttagaggtatgttattattttattttttgagatttataggtttataattttatatttaaaatatttacgggtagatgagttttagaatttagaattttttggtttttagaaaagtaattaataatatattgtaaaatatgtaatatttttattagaattggaatagtaattttggattagaatataggaatatttattttaagtggaataaattgaattaaatggttttatagtttgtttagtttagttttgttgttaaaataagtttaggttagattttgtaatgagtgtaagtttttaaaataaaataagtgaataataataaaataataataaaggaaatgaataaaaattttttgagagaggattagagatttatagttaattaagatttaaattttagttaaggaagaaaaagaaatgtagttttattttattgatttagtattatttaggagtaagtttaatataagtttgattttgtagattaatgaaatgtattttttcgaatattttaaagatttaaagaatttttaaaggaagaaaaaaataattttttttttttttatttaaattttatttaaattgttgaaaatttttttataatattttgatttaaatattgttatatttagtaagtgttaaaggaatatatgtaaatggttaatgaatcgtttttttcgttgtgaattgatttagttttaattaaattgtttttgttttaggtgatttatatattatgagttatttattgttacgttgtatatagtaaggtagtaatatttttaagttttgttagagatatttgtttttagttaaatggttttagttatgtttttgttagtttttttttttttttgtggtttttatgtattttttttgattgtgagatttaattttttttttttaatttaaaataattattaaaggtaagaaataattattaaataattatttaagatatatggtaattatttttatttttatattattatttttatttttatttttatgtgaattattattattattatttttatattaattatagatgagatttttatataaatgattttagtggaattagaagtaatatttaggtaaaaaaaaattataatattttaagagtaaatttgaggttgaatatggtggtttatttttgtaattttagtattttgggagattgtagcgggtagattatttgagtttaagagttagagattagtttgggtaatatagaaagattttatttttataaaaataataatagttagttaggtatgatggtatatatttgtagttttagttatttaggaggttatagtaggaggattgttggagtttagggggttaaggttgtagtgagtaatgattatattattgtattttagtttgggcgatagagtgagattttgttttaaaaatatatatatatgtatatttaataaatgtatttttttttaaggattaaaatgattatgtaagtttatataaatttatgttttattcgttgaattatttgaagtttttagatgttgatatattattttatttttttatgattttgtatatggagttatttttatttgaaatgtgatgtttttttttttaaatttagtaaatttttatttattcgttgtgattattataattggggaatagagttatagagaaaataaaaattattttttggttattttgggtaataggagattttgttgttggtgtaaaattttttagtatattttttttagattagaataaaagaattttggttttattttggtgattagatggttaattgatttataaaatgagttttttttaaattatgtaaaatgatagttggaataagaaattagtagtttttgggggaaaaaagttattttattagaattataaaaatttaaaagtatttatagaaatgaagttaataaagtgttttttaagaatattttatatatatgtgatttgtatttatattgtatttttgtatattgtttttgttttagggaagataattataagatagttataaaaatattaaagttatacgaatttagaatatgtaattgtatttttgtagtgattggtttttatttttttattttttatttttaaatagatttttgttttgttgttttggttggagtgtagtggtattattttagtttattgtaatttttattcgtcgtatttaagttatttttttgttttatttttttgagtagttgggattataggcgtgtgtcgttatatttggttaatttttgtttttttgagacggagtttcgttttgtcgttaggttggagtgtagtggtgggattttagtttattgtaattttcgttttttaggtttaaatgatttttttgttttagtttttcgagtagttgggattataggcgtatgttattatatttagttaatttttgtatttttagtagagatggggttttattatgttggttaggaggtttttaattttttgatttagtgattcgtttatttcggtttattaaaatgttgggattataggcgtgagttatcgtatttagtttaatgtttgtatttttagtagagatggggtttcgttatgttggataagttggtttcggatttttgattttaagtgatttttttatttcggttttttaaagtgttgggattataggcgtgagttatcgtgtttagtttatgattggtttttttgaggtttattatgtagttttttttttttttggaatttgttattagaaatgaaggtagttttttaatattgataaggtagatatagtatttatatgtttttttaattgattaatgatgaaatttaaatgtgcgattttatttatgtaggtgcgagtattcgttaattagttatattagttaagtttggagcgagaagttagtaaaaatttagatttgtaggttattcgaattgtttttgtgaattttattttagatttttggatatatatttttttgagaaagatagtgtttagtaaagtaatagagaagattaaatgttttttttgtcgtattggcgggtttcgtagggagcgtttcggatagtattgtttagatagttaaaggatattttttgttatgttaggttattttcgtttttttatttttcgggagttgaaggagattagtagtatattttagatttttttgttagattttttattgttagattttagtgaaaatggttttggaggtaggaatttgtttttaggtgtgtttggtatgggtttggtttaggaagatattattttattgaggattttgcgaatattagagattttagattttttatagggttaggatttagagagtgttttattggtggatgaggttggtgggagcggtagggttgggtttgtttttaaggggagttttttgtaagttatattttttagtgaaatattgaatttattagaaaaatgtatataataggtaaggaaagaaatatagtattgtttttggatttttataaaattttgtgtaatagatatatatatgttatatttagttgtgtttagaagggttattattattttataatttatattagagaatattttggtttttgagtattttttaaataattaagttgatttacgtgggttttgaggtttgtagtacgtcggatgttattttattatgatagaggattgtggttataatttgatggttgcgaagatttatttttcgtttttttattagataggaggatggtagaagtttggttgttgttataatatttagagttttgtcgtatttggtatatagtagaggtttagatattagaaaggttttattttaataaattatgaggattgttttatggatgatttaagtgttttattaaagtatgaaatgtgaatttttattgttgtatatacgatttaaggtatttaaagtatttttttttttgtgagaaggtttattgttaatataaggtataataaaattatcgtaatttttttttttttagtataattagttgaagttgtagatgttagatattttttataaataagttcgagttaaagttgaaaatttatagtaagattgatatttataaaatagatataaatttttaagagaaagaatttagtattattaaagggataaagaaaaaaatattatttaagatgtgaaaattatagtttaaaatattgttttttttaggttatgtataaaatatatagtgaaaattgtttagtgatattatatttatttatttagaaaattgtgattttaggagaatttaatatgttggtgaatatttttaatttttttttttattaattggtatttttaaaaatataatataaattttttgaagtttttaataaataatttataattgaagtgtataatataaaaaattttaaaaatttaagtagtttattgtttttttgaaagtgtgtgtagttttatttttttaaggaattattaagaatattttttaaaatttaaaaggatggtaagttgtattagaaagttttattttgagatgtaaaaagatttttaaacgtggttatattagttatttatgtatgttagaagtgtagaattggggtatttaatggttattttgtaatagttttgtgtaatttttagtgatgttgtatatatatttgaagggttttttttaaagaaatattaagtatgttttgttgtttagtgtttttgtgaattgtttggttgtaattaaattttgagtttgatattgatatggttttaagaagtagttgtattaagtgaaattattttggagattataataaatatatatatttaa

SEQ ID NO: 58 - DNA, 14238 bp, Artificial Sequence
  bisulfite converted genomic DNA
ttaaatatatatatttattataatctccaaaataatttcacttaatacaactacttcttaaaaccatatcaatatcaaactcaaaatttaattacaaccaaacaattcacaaaaacactaaacaacaaaacatacttaatatttctttaaaaaaaacccttcaaatatatatacaacatcactaaaaattacacaaaactattacaaaataaccattaaataccccaattctacacttctaacatacataaataactaatataaccacgtttaaaaatctttttacatctcaaaataaaactttctaatacaacttaccatccttttaaattttaaaaaatattcttaataattccttaaaaaaataaaactacacacactttcaaaaaaacaataaactacttaaatttttaaaattttttatattatacacttcaattataaattatttattaaaaacttcaaaaaatttatattatatttttaaaaataccaattaataaaaaaaaaaattaaaaatattcaccaacatattaaattctcctaaaatcacaattttctaaataaataaatataatatcactaaacaattttcactatatattttatacataacctaaaaaaaacaatattttaaactataattttcacatcttaaataatatttttttctttatccctttaataatactaaattctttctcttaaaaatttatatctattttataaatatcaatcttactataaattttcaactttaactcgaacttatttataaaaaatatctaacatctacaacttcaactaattatactaaaaaaaaaaaaattacgataattttattataccttatattaacaataaaccttctcacaaaaaaaaaaatactttaaataccttaaatcgtatatacaacaataaaaattcacatttcatactttaataaaacacttaaatcatccataaaacaatcctcataatttattaaaataaaacctttctaatatctaaacctctactatataccaaatacgacaaaactctaaatattataacaacaaccaaacttctaccatcctcctatctaataaaaaaacgaaaaataaatcttcgcaaccatcaaattataaccacaatcctctatcataataaaataacatccgacgtactacaaacctcaaaacccacgtaaatcaacttaattatttaaaaaatactcaaaaaccaaaatattctctaatataaattataaaataataataacccttctaaacacaactaaatataacatatatatatctattacacaaaattttataaaaatccaaaaacaatactatatttctttccttacctattatatacatttttctaataaattcaatatttcactaaaaaatataacttacaaaaaactccccttaaaaacaaacccaaccctaccgctcccaccaacctcatccaccaataaaacactctctaaatcctaaccctataaaaaatctaaaatctctaatattcgcaaaatcctcaataaaataatatcttcctaaaccaaacccataccaaacacacctaaaaacaaattcctacctccaaaaccattttcactaaaatctaacaataaaaaatctaacaaaaaaatctaaaatatactactaatctccttcaactcccgaaaaataaaaaaacgaaaataacctaacataacaaaaaatatcctttaactatctaaacaatactatccgaaacgctccctacgaaacccgccaatacgacaaaaaaaacatttaatcttctctattactttactaaacactatctttctcaaaaaaatatatatccaaaaatctaaaataaaattcacaaaaacaattcgaataacctacaaatctaaatttttactaacttctcgctccaaacttaactaatataactaattaacgaatactcgcacctacataaataaaatcgcacatttaaatttcatcattaatcaattaaaaaaacatataaatactatatctaccttatcaatattaaaaaactaccttcatttctaataacaaattccaaaaaaaaaaaaaactacataataaacctcaaaaaaaccaatcataaactaaacacgataactcacgcctataatcccaacactttaaaaaaccgaaataaaaaaatcacttaaaatcaaaaatccgaaaccaacttatccaacataacgaaaccccatctctactaaaaatacaaacattaaactaaatacgataactcacgcctataatcccaacattttaataaaccgaaataaacgaatcactaaatcaaaaaattaaaaacctcctaaccaacataataaaaccccatctctactaaaaatacaaaaattaactaaatataataacatacgcctataatcccaactactcgaaaaactaaaacaaaaaaatcatttaaacctaaaaaacgaaaattacaataaactaaaatcccaccactacactccaacctaacgacaaaacgaaactccgtctcaaaaaaacaaaaattaaccaaatataacgacacacgcctataatcccaactactcaaaaaaataaaacaaaaaaataacttaaatacgacgaataaaaattacaataaactaaaataataccactacactccaaccaaaacaacaaaacaaaaatctatttaaaaataaaaaataaaaaaataaaaaccaatcactacaaaaatacaattacatattctaaattcgtataactttaatatttttataactatcttataattatcttccctaaaacaaaaacaatatacaaaaatacaatataaatacaaatcacatatatataaaatattcttaaaaaacactttattaacttcatttctataaatacttttaaatttttataattctaataaaataacttttttcccccaaaaactactaatttcttattccaactatcattttacataatttaaaaaaaactcattttataaatcaattaaccatctaatcaccaaaataaaaccaaaattcttttattctaatctaaaaaaaatatactaaaaaattttacaccaacaacaaaatctcctattacccaaaataaccaaaaaataatttttattttctctataactctattccccaattataataatcacaacgaataaataaaaatttactaaatttaaaaaaaaaaacatcacatttcaaataaaaataactccatatacaaaatcataaaaaaataaaataatatatcaacatctaaaaacttcaaataattcaacgaataaaacataaatttatataaacttacataatcattttaatccttaaaaaaaaatacatttattaaatatacatatatatatatttttaaaacaaaatctcactctatcgcccaaactaaaatacaataatataatcattactcactacaaccttaaccccctaaactccaacaatcctcctactataacctcctaaataactaaaactacaaatatataccatcatacctaactaactattattatttttataaaaataaaatctttctatattacccaaactaatctctaactcttaaactcaaataatctacccgctacaatctcccaaaatactaaaattacaaaaataaaccaccatattcaacctcaaatttactcttaaaatattataatttttttttacctaaatattacttctaattccactaaaatcatttatataaaaatctcatctataattaatataaaaataataataataataattcacataaaaataaaaataaaaataataatataaaaataaaaataattaccatatatcttaaataattatttaataattatttcttacctttaataattattttaaattaaaaaaaaaaaattaaatctcacaatcaaaaaaaatacataaaaaccacaaaaaaaaaaaaaaactaacaaaaacataactaaaaccatttaactaaaaacaaatatctctaacaaaacttaaaaatattactaccttactatatacaacgtaacaataaataactcataatatataaatcacctaaaacaaaaacaatttaattaaaactaaatcaattcacaacgaaaaaaacgattcattaaccatttacatatattcctttaacacttactaaatataacaatatttaaatcaaaatattataaaaaaattttcaacaatttaaataaaatttaaataaaaaaaaaaaaaattatttttttcttcctttaaaaattctttaaatctttaaaatattcgaaaaaatacatttcattaatctacaaaatcaaacttatattaaacttactcctaaataatactaaatcaataaaataaaactacatttctttttcttccttaactaaaatttaaatcttaattaactataaatctctaatcctctctcaaaaaatttttattcatttcctttattattattttattattattcacttattttattttaaaaacttacactcattacaaaatctaacctaaacttattttaacaacaaaactaaactaaacaaactataaaaccatttaattcaatttattccacttaaaataaatattcctatattctaatccaaaattactattccaattctaataaaaatattacatattttacaatatattattaattacttttctaaaaaccaaaaaattctaaattctaaaactcatctacccgtaaatattttaaatataaaattataaacctataaatctcaaaaaataaaataataacatacctctaaccaaaataaaattaatatcttcctatataaaaaacaactaaatcaaaaataaactaaaataaacaacaatatataatatcgcctcttaaaatacttttaaaaactacgctaaaataaataataatatcaaaacaaaacatacttaatttaaaaaaaaatctttacaaaaaataaaataaaacatcttaatttcttccttccataaactttaaaatcttcaactatacctaaaaactcaacaattccctcaactctacaaaccttttctcaaataaaatatttattactaaaacccaaaaattttaaaaaacttaaaatatcccccaccctattaataacaaaatctaatctaaacctccatattaccttttctattctaccaatctaactttctatttaattattatttcctaacaataaaattattaataaaaaacataaaatctatattttattcacatcacatactacgttcctaaaaataaaaaaaataataacgttaaatctattaatatcaaatcctatatataatctctaaaaaaaacctacgaccgaatttatacgaacttaaaccttcaaacctccaaataacaatattactccacttaaaaatttctaatactacctccctaacaaacactatataaaaccatctccgaaactcgcaaaacaaaattttaattaaatctaaacctaacgtttctaaaatttttaacactaaaaatattttattactaattacttctcctaccacaacctcaaaaaaaacataactactactaaaaaaaaaaaaatttttaaataattaaaataaaatttataaccattcaaaaaaatacattaaaaattaacattttaaaatttctataaccttttaaaaaaattaaaatattataaaacaattaataataaattttcataatcaaaaataataaaaaacaaaaaaaaaatcatttctatacctcatctcatccacaacaacaataaatttcgactaatataaaaaaaaataaaaaaaaactatattaaaaatatactctattttaaaattttccataaaaaaaaaaaaatttacaattaatacaaaccactaaacctaatcattcaatatcttttcaataaaaaaaaattcacaaaataataaaaatataaatttaaaaaacaaaaatccaaattcaaataaaaacatcctcaaaaattaattaaattaaaaaaaatcaatataaattttactttacaacgtatttcaattaaaacttacttcaaataaaaaaaaaaaaaaaacaaaacaaacaaaaactccacgcatcttacaatatttaaaaacataaaacaacctctacttcactttaaataaactacttaatttactatttccaaaaaaacaaaaacaaccccaattaaaataaaaacatccgaaataatacttcaatatctcgtaaaaaaataaaaacacttttcgaaattcttatccaacaaaccctatattttacataattaaacaaattcaaacaattttcaatattaaaaaaatatattactaataaaactaaacctccgaatcaaaaaaaaatataaccgaacataataactcatacctataatcccaacactttaaaaaactaaaacaaacgaatcacctaaaatcaaaaatttaaaaccaacctaactaacataaaaaaacccaatctctaccaaaaatacaaaattaaccgaacgtaataatacatacctataatcccaactacttaaaaaactaaaacaaaaaaatcacttaaacccgaaaaataaaaattacgataaactaaaattacgccattacactccaacctaaaccacaaaataaaactccgtctcaaaacaaaaacaaaaacaaaaacaaaaacaaaaaaactcactaaatacaaacaacgtatctcctttcttccaattttaaatctttttctaataactcctactatatacatataatttattattaatattaacatattacaatattctaaattattttattttcttttaaaaaaaatctcactctatcacccaaactaaaatactataatacaaacataactcattacaacctcaacctcctaaactcaaacaatcctccaacctcaaccttccaaattactaaaaccacaaacacatattaccacacccacctaattttttttaaattatattattcacacttttttttaaaataattaaaaattaaaactcaaaaacaataaaacataactttaaaaaaatacaataaattcaaaaaaaaatataataacaaaaaaactataaaaaaactatatactataaaaataaatacccaaactttaaaaacaaacaaacctctattcaaatcctaactctacccttataacgtatatacaaattattaaaatacttaatacaatacctatcgtataacaaatatattaactctcattactttttctttcaacccatatataaaaacttacccaatataaaaaatatcaataatttaaaaactataacttaaaaataactttaaaatataattaataatataatatcaaaaacatatacttcctacttaataatttatttacaaaaaatattaaaaaaaaaatattaaactcttaattaaatttaataataaactatcaaaacaataacgctttccaataaataacaaaatctataactaaatttaaatatatatactacttattctattccaaacacataaaaaaaattatctatataaactcaattatcccactaccttattaaaaatccaaaattaacacaactattactaaaaattcttatcactttctttttttcaaataaaaaataataaaaataattattaactaaataatatataaaaaaacttaattcttcttctaaccatttataaaaaacaaattaaatctctacaaactttataaatcaacctctacactaaaaatttctatttttttttatttatttatttttaaaactctcacattaaatattctaataaaaaactacaaaaatcacgtcaaaactaaaaaaaaaaatcttattaaaaaatattcaatacaaacaaattaacaaatcaaaaaaacataataaaataaacattaaacgaaaactcacctataactaccctataaattacaaaataatataaattcttcatttacaacttaaaaaactaaaatataaaaaaaataaaaatactaatcaaccctactttctccttaaaacttttcaaaattcaaataaaataccaaatataaaaataacttacttttatattactcaataatcttcaaattactactactaaatctacaattacatattataatttaaaacttccttctaaacattacaattttttaaacttaaccaaatttatttaaacaaatccaatcttttaaattctatcataatcatacccaaatttataacatttctcttatatatataaatatacttcacactcatctaacatcccatcaattattttataactccacttccaatttacctacaataaacaaaaacatatctatttacaaaatttttatctatccttataaacttttactaatcaaatactaataaaaactttataaaaacaactaatttataataaaaaaccaaataaacaatcacaaaaaatattttcctaaaaacctaaattttacctcaccaaaacaaaaaattaatcaaattaactattctacccctaactaaaataaatatttattacttcaaaattaaaaaataaaaaaaacaaataaacaataaatacaatcttaaattacttatatataaaaaaaaataaccttcgaaaccctataataactatttaaccctaaaacaaaatatttaattataataatcatcttaatattcattaataactacaaaattaaacactaataattcatcaaactacaacatttaaaaccaaaaccttaaaaaactatcttacttacatatttctaaaaaattcaatccttttcgtttatcttaaatataaactctcacttcttattctcacaaaattttaaaaattctcacttccaaaattctcctatatttaaaaaaactataaaactaattataaataaaaaaataaacaaaataacaaaaaccacctacccactaaatcttatcatataatattccttataaatcatacttacaccttctctaatcattaattataacccaattcaaaaaatactacaaattcaacacaattccttatatccacaactaatttcccaacctttctcaaatttccactccaatcttaactctatttataaaatatatatattttaaataacaaattaaaatttattttttatactaaactcaataccaacccccctctaaaaactataactctttcttccctaatatccaaaaaacaaaaccttaactacttttcaataactacttattttccttaaatattatatcaaactttctaaaattccaaataaactacatttactttattaacctttccaaaacatttaaaataattccaacgctttaattttccttaaataaaattaacaaccacttaatttaataaaattaaatacttcattaatttctttaaaactaaaaataaactcaactactttcaatatcaaaaaattctaaactttaatcttaatttacaacataaatataaaaacataaaaaaaaaaaattataaaaaaaaaccaaaaaaaactatatttacgaaaaaatttttaattatttcaataattactaaattataaaaaaaaaaataaataaataacataataaacccatcatttatcactaatttataattaaactaattctaaaattaaactttaataaccaaaactaaaaacgacaaactaataccactactattttaaaattccttatttctcacaaaactatataaatacttaactaataaaattacttcttaattaaactaatttcaattttcaaatcaaaattacttaaaatttactacacgttactaacattatacaaataaacaatatttcttattaattaaaatataattaatctacaaaccacaaatacaactcctataatttcttacctctaaatcctcaaataatttcaaaactttatataaaaaccctaaatcttaaatccaaatctaccacttcaacctataaaataaattaaaccttatatatctctctaaatattaaaaaaaaataattcatccgtaactatacaaaaatccataactttacatacttacttccaaccaaaacacatttataaaatatatacatattactaaccttctaactctaattcctctatccctttaaataaatattctaaaaataacaaccattcactttatcatttactattctataaaacacaaaacaaaaacccaaaaacaaaaaccccatcaaaaacaatattatttcttccaaaatctcactttattctaaattaccattacaaacaataaaatatatttatataactcaaatataacttaactctataaattatattaaatcctaaaataacttaaaaactcttataacctattatatttacttctatttatacaaattaataaaaacctactatattctaactctaaaccccctctaaattccttccatttacaatcacttttatcaaaaatatatttttacaccaaaaatccctaaacaatatcaataaaaaaaaaaaaaaaataataacccattacattttatattctcttattcccaacaaacataaaaaaaaacaattatctctttttaaattaataatttaaaatttccaaaaatacaatattttaaaaaataaaaaaactcataactaattactttcaaaaaaaactctaaataaaatattacattattctacccatctacttctaatacattccattttaaccacaaacaaaataaaaaactaaataaaatttaaacctttctatttatcatattttaaaaattaatccaaaaacaattcttaaaaaataaactaaaaataaaatataccaaaactccaacccacgctttacaaacgccaaaataaaaaatattctacgaaaaaaacgtaatataataacacataaactaaatctaacctcaaacgacctaaaatccattacaaactataaaactttaacttaaaaaaacaaaaacaaccatctctaaacctcgatttctctaaaataatactatacctcgcacaattatcgaaaattcaaatcccataccctatatatatcaacctatccataattaatcaccctaaaaaactttactttcctaatctaaacaaaataaaaaaaactaaatctaaaccctaccctatatataaattaaaatttatatactttaaactaccctcccaaaacacaccataataaaaaacaaaaaacctaacttaactatataaattcgactaaattattttaaacgtatcattcactccctcaataaaataaaaaaattaaactaaaacacctcttaatatctcttctaactttaaaattctacgcaatccacgaaaaaaaaaattcaaaaaaccttacatacatcaaaacaccaaaaaccccactttccttaaaaataatttacaacgaacaaatcaccatccctaacatttcaaattttacaattcacaattcacaatacgaaaaaataaactaaatcacactacaacaaactcccctccacgtctaacaaaaaaaacgaaaaattttcttaaaaaactcgaccaatatcaaacaacaaaaaataaaaactatctcgataaaaaaaaaaacccaaacttccgaaaacataaactaaaaaatataaaaacaaaacacctactaaatctcgttaaaattaaaacttcaaaaaaaattaaacctactctaaaaaacaatataaaaatcccaaccccgacctaaaaacgacacgttcactaccaaaaactcaaaaaaaaaacaaaaaacgaaaaataaacgcgaaaaataaatacgaaaaaaaaaccgaataaaaccccaaccccgatcactcaccacgaacgaaataaaacaaataaacaccaccaaaaaaataacaataaataaaataaccatctaaatctcgacgcccgcgatacgacgaaaactccgacgacgccgaaaatcgctaaaacgcgacaaaactaaaaaaacaacgaaataaccccgaaaaacaaccgaaacgaccgcgaccgcgtaatactactcgatacccaacgaaatacgacgcataaactaacgatacatacgaaacaacgcgccgcacacaaacacgttacaaaaaacgataacgaaaataaaaaaaaaactaaaacccgcgtacatataaaaataaacgacgtacgccgtcacgttaataatccaatcgataaaacaccaaatatctaaatactacaaccgcgaactaccgaaacccatattaaacaacgcgcaaaaaaacacgttaaacgcataaactacaaaaaacgtaaaacccgccaatcgcttatccacgtaataactataaaaataaacataattaataaccaaataacgctcgacactcataacgcaaataatactaaaaccgaacaaactaaaaaaaaacaaaataaaaatactatactcgcacaacgactaacccccgaaccattaacccttcatatacgtaacgataatcaccgaactcaccaacaaaatacccaacaaatcgataacaaccaacccacataccaacgtataaaaaatcgtctccttctactccttacgcgacttacacaacaccacgataaccaccaaattacccaccaccccgaaaataaacatcaccgccgaaataatcactaaactattcaaccgatcgaaactcaaaaaaacgaacgaattaaccccgaaaataaacataataataactaacgatacgcaaccttaaaatacaaaactaaatctaaaaataataaaaaaaaaacaaaactaccgtaaacgaaaattaccacttataaaatattaaacccgcgcccgaaaaacgatacactaataaaacaaaaaaaacaactcgatcctactttctaaattataaccacttaccaactacgaccaccaaaatctccaaactcgcgatacgtcctaccaacaacacactcttactaacattaatatttataaactaattttcccattcctcttcctccccacaatccaactcactccattaccaaaataaataaaacccatctcaaaaaaaaaataactcgctaatactattctcgataaattctaaatcaataaaatactcactaaaaacaaattacaaaaacaatttaaaaaacgcgctcttcccttcttaactctcttcgacgaaaaccgcatccctacgttctctacccgttaaccccaacgtcaacccaacgccatctcacctataacgacaacaacgataacaacctcacgaacccccaaaatcaaccctcaaatatcctaaacccgcctccaacctactttcaccttatcctactcaatctaaaaactaccaaatcttcgacttctcaaaaccgatctcaataactatcgatttttaaacaccgaaatcaaaattaccaactttcaaaaacttaaaaaacaaaaaatacaacgaaataaatcaataaaaaataatactaaatttcttactcgctattttttttccttcaaaaacgaatcccaactttacaatacccgccgatctcgtctacgaaaaaacaacgttcaaatataaaactatacgcgcaaataacgcgaaaccttaatccccaactctaactaccctccgccccaaccacgaacaacacgaacgactactaaaatttacgactaccgctaaaaccgctcctaactacctaaaaacgactcgaaatccactctaccaaaaactctaacctaaaactattcatcttcctctcgaactaccgaacttaaaactccgctctcgcctttccaccctctatacaaacttttctcctcctccaaatttccctaacgaaaacgaaaacaaaccgcgcgctacccgaacgcccattaaccgaattaaaaaaaaacgaaacgcgtcctccctaaacgccgcaaaaaaaactaacgaaaaacgatatctaaactaaaacgaaactaaacgcgcgaaataaaacgactcccgtaattttcacgccctcgaaaatacgaaataaaaactcgaaaaaaaccctaaaaaaccccgatactttccccgacgaccgcttaaccgctcctaaactcgacttccaataaaaccaccactaaaaccgacgaccgtttccgcctcgctacctaccgctcgaaatatactatttcttaaacctcctatccgcgaaccgcaacatctaaatcgtaaaaaaaaaaacaattatttt

SEQ ID NO: 59 - DNA, 14238 bp, Artificial Sequence
  bisulfite converted genomic DNA
aaaacaactaccctctcttccacgatctaaatattacgacccgcgaacaaaaaattcaaaaaataatacactccgaacgacaaacaacgaaacgaaaacgatcgccgatttcaataataaccccactaaaaaccgaattcaaaaacgactaaacgatcgccgaaaaaaacaccgaaacttcccaaaatcccctccgaattcccactccgcacctccgaaaacgtaaaaaccacgaaaaccgccccaccccgcgcgcccaaccccgccccaacccaaacaccgccccccgccaatcttccctacgacgcccaaaaaaaacgcgctccgcccccttccaatccgaccaataaacgcccgaacaacgcgcgatttacctccgcctccgccaaaaaaacttaaaaaaaaaaaaaaatttatacaaaaaataaaaaaacgaaaacgaaactccaaacccgacaacccgaaaaaaaaataaacaaccccaaaccaaaacctctaacaaaataaaccccgaaccgcccccaaataaccaaaaacgacctcaacgacaaccgcaaactccaataaccgcccgtactacccgtaactaaaacgaaaaacaaccaaaactaaaaaccaaaactccgcgccacctacgcgcacaacctcacacctaaacgctatcctcccgcaaacgaaaccgacgaacactacaaaactaaaactcgtctttaaaaaaaaaaaaataacgaataaaaaatccaacaccattcttcactaacccatcccgctacacctcttatttcccaaatttttaaaaactaacaactctaacctcgatatccaaaaatcgacaaccactaaaaccgactttaaaaaaccgaaaatttaacaatttccaaactaaacaaaacaaaataaaaacaaattaaaaacgaatccaaaacatctaaaaactaaccctaaaaactcgtaaaactaccaccgctactaccgctacaaataaaataacgttaaactaacgttaaaatcaacgaataaaaaacgcaaaaatacgaccctcgccgaaaaaaaccaaaaaaaaaaaaacgcgctctccaaattacttttataacttattttcaataaacattttattaattcaaaatctatcgaaaataacactaacgaactacttttcccttaaaataaatcttattcatcttaacaataaaataaattaaattataaaaaaaaaaaaaaataaaaaaatcaatttataaatattaatatcaacaaaaatatactattaacaaaacgtatcgcgaacctaaaaattttaataaccgcaattaataaataactacaatccaaaaaataaaatcgaattactccccttatcttatcaatatatcgtttctcgaacgcgaatctaacaccttacaaataataatttccgctcacgacaactttatctctcttctaccatccccaaacccaaccttacactccaaaactacgcaccgccaaccactatcatatccactcccgaaatcaattcgtccgcctccttaaaccccgaccgactaaacaacccaataaccatcccgacgataatattcatcttcgaaataataaacaacctaataaccatcgtaatactatacaaatcgcgcaaaaaacaaaaaaaaacgaccttctacacgctaatatataaactaactatcaccgacctattaaacactttattaataaacccgataaccatcgccacgtacataaaaaaccaataacccgaaaaccaaccgctatacgaatacaacaccttcattctactcttcttcaacctatccgacctcaacatcatctacgccataaatatcgaacgctacctaaccatcaaccatacctatttctacaaccactacgtaaacaaacgattaacgaacctcacgctctttacaatctatacgtccaacgtactcttttacgcgctacccaacataaatctcgataactcgcgactacaatacccaaacacctaatacttcatcgactaaaccaccaacgtaacgacgcacgccgcctactcctacatatacgcgaacttcaactccttcctcattctcgccaccgtcctctacaacgtacttatatacgacgcgctactccgcatacaccgccaattcatacgccgcacctcgctaaacaccgaacaacaccacgcgaccgcgaccgcctcgattacctcccgaaaccaccccgctacctccccaaccttaccgcgcctcaacgactttcgacgccgccgaaacttccgccgcatcgcgaacgccgaaatccaaataatcatcttactcattaccacctccctaataatactcatctactccatcccgctcgtaataaataaccgaaactaaaaccctactcgacctttttctcgcatccacctcccgcgtccattccccgctccctactttccctctaaatccttaacaataaacgtatcgcctttaaatcgaaactaaaattcccacactatttctcaaaacaaacccaaccctctttaaaatcccaaccctaacgaaatttaacaaatactttacccctacatcccccaatttatattcccgaaaacctaaatttctttctccaccgaaacaacccttaccccttactacctaacactaaccgaatcttccaaaaaaaccccccgccccctctattaaacgtaaaaaaaaacctactataatataacttaacccattcctccgtactataaactataaactacaaaacctaaaatatcaaaaataataatctattcgttataaaccatttttaaaaaaaataaaatttttaatattttaatatatacaaaatttcttaaatttcttcccccgtaaattacgtaaaattttaaaactaaaaaaaatatcaaaaaatattttaatctaactccctcacttcactaaaaaaataaataatacgcttaaaataatccaaccgaacctacacaatcaaactaaactccctactctttaccataatataccctaaaaaaacaacttaaaacacacaaattctaattcatatacaaaacaaaatccaaactcaatttctttcattctatctaaaccaaaaaaacaaaatttctcaaaataactaattataaacaaactaatatacataaaatataaaatttaaattctcgacaactatacgaaatacaataccattttaaaaaaaccgaaatttaaaaataactatctttatttcttcaaaccaaaactctacaacttataataaaccttaaaccgtctaaaaccaaacccaactcatatattattacatcacgtctccctcgtaaaacatttctcattttaacgtttataaaacgtaaattaaaattttaatacacttcatttttaattcatcttttaaaaattacctttaaattaacttttaaaatataataaacaaaaaaactcaaaccctacctaattttctactttacctataactaaaataaaatacaccaaaaacaaataaacaaaataatacaatactttatctaaaatttctcttaaaaacaactaattataaattcttccatcttccaaaacactacattcctaaaaattctaaactaccaactcaaaaaaaaataactactttttcttatacttattaaaaacaaaaaaatataaaatataataaactattattccttccttttccttattaatactatccaaaaatctttaatataaaaatatatctttaataaaaataactataaataaaaaaaacttaaaaaaaactcaaaaccaaaatacaataaattcttaccaatttatataaacaaaaataaatataataaaccataaaaacctttaaaccattccaaaacccaatataatttacaaaattaaatcacacttaaaccacataaatatattttactatctataataacaacctaaaataaaataaaattttaaaaaaaacaacactactcctaataaaacccctattcctaaacctctaccttatattttacaaaacaataaataacaaaataaataattattattttcaaaacatccacttaaaaaaacaaaaaaattaaaactaaaaaattaacaacatacacatactttataaatatattttaattaaaaataaacatataaaactataaatttctacacaaccacgaataaattattttcttccaacatctaaaaaaacatacaaaacttaattcacctcataaactaaaataataaacctaaacctaaaattcaaaacccttacacaaaaccttaaaattatttaaaaacctaaaaacaaaaaattataaaaactatatttataatttacaaattaaccacattttaactaacaaaaaatactatccacctatataatattaataacgtataataaattttaaataatcttaacctaaaaattaaaactaactcaattaaaaaataatcccattaatcaaatatttatataactttataaaaaataaaaaatcctaaaataacaataacatcaatttatcgcctttaattttaactactaaaatctaatttcaaaatcaatttaattataaattaataataaataataaattcattataccacccacccacccccccccccacaattcaacaattactaaaataatcaaaaacccttccgcaaatacaatcttccttaacttccttttacaactttcttttttcatattttcatattcatattataaattaaaattaaaactcaaaactctctaacattaaaaacaattaaacttatcttcaattccaaaaaaactaataaaacatctaattttatcaaatcaaataattactaatcccatttaaaaaaaatcaaaacgttaaaatcattttaaatactttaaaaaaactaacaaaacaaatataatttacttaaaatttcaaaaaacttaatataatacctaaaaaaaacaaacaaccactaaaaaacaaccaaaattttacctcctaaacaccaaaaaaaaaaaaactacaactcttaaaaaaaaattaatattaaatttaatataaaaaataaattttaatttactatccaaaatatacatatttcataaataaaattaaaattaaaataaaaatttaaaaaaaattaaaaaattaattataaatataaaaaactatactaaacctacaacattctttaaactaaatcataattaataatcaaaaaaaatataaatataatctacaaaaaacatcacataacaaaatttaataaataaataattcttatcattttatccattcttctatttataaccaatctcataatttttttaaatataaaaaaattttaaaaataaaaacttctaaaattttataaaaacaaaaaataaaaatctacatttaaaataaacgaaaaaaattaaattctttaaaaatatacaaacaaaacaacctcctaaaatcctaattttaaatactataacttaataaattactaatacctaattttacaattactaataaatattaaaataattattataatcaaatattttaccttaaaactaaacaattactataaaatttcgaaaatcattttcccccatacacaaacaacccaaaactatatttattacttacttatttcttttattttttaactctaaaataacaaatactcatctcaactaaaaacaaaacaactaatttaattaatcttctaccttaataaaataaaacttaaatccttaaaaaaatacttcctataactatttatttaattccttactataaactaattatctctataaaactttcaccaacatttaatcaacaaaaatttataaaaacaaataaaaactttataaataaatatacttttatttactataaacaaactaaaaataaaatcataaaacaactaataaaatatcaaataaatataaaacacatctatacatacaaaaaaaataccacaaatttaaatataactataacaaaatctaaaaaactaaatttattcaaataaatttaactaaatttaaaaaattacaatacctaaaaaaaaattttaaatcataacatacaattacaaacccaataataataacctaaaaactattaaataacataaaaataaattatttccacatctaacatttcatttaaatcttaaaaaactctaaaaaaaaaataaaactaaccaatattttcactctctctacacctcaatttcccaaactacaaataaaaaatttatatcattctacaacttacaaaataactataaataaatcctcgtctaatactcatttcaccatactttcttaacctatcaatttatttatattaaatatctcctaacaaaattttttttctcaaccctaacgtaattcttataatctcctatcaaaatattcaatataaaaactttaaaaacaaacaaataaaaaaaaacaaaaactttcaatataaaaattaacctataaaacctataaaaatttaacttaccttctacaaataaccaaaaaaaaaaccaaactctcctacacaccacccaatcaataattatttccactattctttacttaaaaaaaaaaaaataataaaaacttctaataacaactatatcaattttaaactcttaacaaaacaataaaataactaaacccatacaaataattccttttatatacttaaaacaaaacaaataacacacacattcaaatccaactacaaatcttatcacttattaaaaaacgttactattttaacaatccattactaaatctaatcaaaaattcaacattctttcttcaacattccctacaaacaaattattaaataaaaaatacatatttttaataccatattattaactatatcccaaaactacctctaaactacaattttcaaattattaataccttccacactaaacaaacttccacatataaattaaaaaaaaaaataataaaaaccaacatatctattatacgataaacactatactaaacactttaataatttatacatacgttataaaaacaaaaccaaaatttaaacaaaaacttatttacttccaaaacttaaacatttatctctacaacatataacctccttacaactttcttatcaccacatcttcttctaaacttattacatttcctcaaaattatattccactactcctaaaccctaatctctaatcatcctaaaaaaaaatataaataacataatttaaaaaaaattaaataaatataataacatatacctataatcccaacaacttaaaaaattaaaactaaaaaattacttaaacccaaaaaattaaaactacaataaaccatatttatatcacaacactccaacctaaataacaaaataaaaccctttctaaaaaaaaataaaataatttaaaatactataatataccaatattaacaacaaaccacatatacacaacaaaaactactaaaaaaaaacttaaaattaaaaaaaaaaaaatacgttatttatattcaataaatttttttatttttatttttatttttatttttattttaaaacgaaatttcactttataacccaaactaaaatacaataacgcaatctcaactcaccgcaacctccacctcccgaattcaaataattctcctacctcaaccttccaaataactaaaattataaacatacaccaccacgcccgactaattttatatttttaataaaaactaaatttctccatattaatcaaactaatctcaaactcctaacctcaaataatccgcctacctcaacctcccaaaatactaaaattacaaacataaaccaccatacccgaccatattccctcctaactcgaaaattcaattttatcaacaacacactcttccaacactaaaaactacctaaacttatttaattatataaaatataaaacctattaaacaaaaattccgaaaaatactttcaccccctcacgaaacattaaaacactactccgaatatccccatctcaactaaaattatccctaccctcttaaaaacaacaaatcaaataacctacttaaaataaaacaaaaattactctatattttcaaacattacaaaatacgtaaaatttttatttattttatcttttttctttccctacttaaaataaatctcaattaaaatacgctacaaaataaaactcatattaattcttttcaatctaaccaacttttaaaaatatttttacctaaatttaaacttttactttttaaactcatacttttactaccctataaactcccctttattaaaaaaacattaaataaccaaattcaataacttatactaattataaacttttcctcccccataaaaaactttaaaataaaacatacttttaatataacctcctttcattccctcctatactaatcgaaatccattactactataaataaaataaaacacaaaaataattctttccttacctctcatcacctttaattataaaaacctattattaattattttacaacattccaacctttctaaaaaaccacaaaaattttaaaatactaactcctaatatacttctttaaataactataaattccattttaactattcaaaaattttcttcctttcaataataaccatatttcctttaaaattataataaaaaaaacaaccaacaataaaacattttcaatatcaaaaatctcaaaaacgtcaaattcaaacttaaccaaaattctattctacgaatctcgaaaataactttacacaatacttattaaaaaaataatatcaaaaactctcaaataaaacaacactaccacctaaaaacttaaaaactcaaattcgcataaacccgaccgtaaatcttttccaaaaaccacacacaaaacttaatactaacaaatttaacgccatcatttcttctacccttaaaaacgtaatatataatataaataaaatataaacctcatactttttaccaacaattccattatcaaaaaataataattaaacaaaaaaccaaactaataaaacaaaaaaaacaacataaaaatccaaaccaaactctaccaccaacaaaataaaaaacatcctaaattcctcaaaacctctaaatctcaataacaaatacctcatctaaaaaaaaacctataaaattaaaaaaactactaaatttccaaacataactaaaaacctcaaaacttataaaaaaaaaaaaccaaaatactttattttactttctataaaaatttttttttaaatcaaatatactttaccttaatactatcatttatcccaacgtaatttctaaaaatatttcaaaaaacgatattacacactactattcattctaattcattcttaatttaactatcttccatataaaaaaatattaatttcatcttaattaaaaacatatcactattttattctctaaaatttacaaacccataatcccatatccaaaatatttacgaacaaataaatttcaaaattcaaaatttcttaacttttaaaaaaataatcaataatatattacaaaatatataatatccccatcaaaactaaaacaataatcctaaaccaaaacataaaaatattcactctaaataaaataaattaaactaaataacttcacaatctattcaattcaattttactaccaaaataaatttaaatcaaattttacaataaatataaattctcaaaacaaaacaaataaataacaacaaaacaataacaaaaaaaataaacaaaaatcttttaaaaaaaaatcaaaaacctataactaattaaaatctaaattccaattaaaaaaaaaaaaaaaatacaattctaccttactaatccaatatcatccaaaaataaatttaatataaacttaattttacaaattaataaaatatatttcttcgaatattttaaaaattcaaaaaatctttaaaaaaaaaaaaaaataattcttccttcttttacccaaattttacccaaattattaaaaatctttctataatatcctaacccaaatattattacatctaataaataccaaaaaaacacatacaaataatcaataaatcgccttttccgttataaactaactcaacctcaactaaactatccctattccaaataattcatacaccataaatcattcattattacgctatatataataaaacaacaacatcctcaaatcttattaaaaatatttacccctaattaaataactccaactatacttttattaattctttctcctttttataatttttatatatcttccttaactataaaactcaacctcttctccctaacctaaaataattactaaaaacaaaaaataattactaaataattacttaaaatatataacaattatttttatttctatactactatttctatttctatttctatataaattaccactactactatttctatattaattacaaataaaatttttatataaataatcccaataaaattaaaaataatatctaaacaaaaaaaaatcataatactttaaaaataaatttaaaactaaacataataactcactcctataattttaacactttaaaaaactacaacgaacaaatcacttaaactcaaaaattaaaaaccaacctaaacaacataaaaaaacctcatctctacaaaaataataacaattaaccaaacataataacacacacctataatcccaactactcaaaaaactacaacaaaaaaattactaaaacctaaaaaatcaaaactacaataaacaataattacaccactacactccaacctaaacgacaaaataaaaccctatctcaaaaatatatatacatatacatttaacaaatacattttcccctaaaaattaaaataatcatataaatttacacaaattcatactccattcgctaaatcatttaaaattcccaaatattaacatatcatttcattcttccataactttacacataaaactacctctatttaaaatataatatctttccttctaaatttaacaaattctcattcatccgttataattactataactaaaaaacaaaatcataaaaaaaataaaaactattctctaatcattctaaataacaaaaaatcctactattaatataaaacttttcaacatattctttctaaactaaaataaaaaaatcttaaccttattctaataattaaataattaattaacttataaaataaatttcctttaaattatataaaataacaactaaaataaaaaatcaataacttttaaaaaaaaaaaattacttcattaaaattacaaaaacttaaaaacactcacaaaaataaaattaataaaatacttctcaaaaacactttatacatatataacctacactcacattacatttttatatactatctttactctaaaaaaaataatcataaaataattacaaaaatattaaaactatacgaactcaaaacatataattacatttttacaataactaatttttatttttttattttttatttttaaacaaattcttactctattaccctaactaaaatacaataacatcatctcaactcactacaacctccacccgccgcattcaaaccattctcctacctcaccctcctaaataactaaaattataaacgtataccgccacacctaactaatttttatttttttaaaacgaaatctcgctctatcgccaaactaaaatacaataataaaatctcaactcactacaacctccgcctcccaaattcaaataattctcctacctcaacctcccgaataactaaaactacaaacgcataccaccacacccaactaatttttatatttttaataaaaataaaatttcaccatattaaccaaaaaattctcaatctcttaacctaataatccgcctacctcgacctaccaaaatactaaaattacaaacgtaaaccaccgcacccaacctaatatttatatttttaataaaaataaaatttcgccatattaaacaaattaatctcgaactcctaacctcaaataatcctcccacctcgacctcccaaaatactaaaattacaaacgtaaaccaccgtacccaacccataactaatttttctaaaacttattatataacttcctcttttcctaaaacttattaccaaaaataaaaacaacttcctaatattaataaaataaacataacatttatatattttcccaattaattaataataaaatctaaatatacgatctcacttatacaaatacgaatattcgtcaaccaattatatcaaccaaatttaaaacgaaaaatcaataaaaatccaaatttacaaaccatccgaattacttctataaaccccatcctaaacccctaaatatatatcctcctaaaaaaaacaatactcaataaaacaataaaaaaaatcaaatacctcttctaccgcattaacgaatcccgcaaaaaacgctccgaacaacactactcaaacaatcaaaaaacatcttctaccatatcaaaccactctcgctccttcatctcccgaaaactaaaaaaaatcaacaatacatctcaaaccctcctaccaaacctctcactaccaaacctcaataaaaataaccttaaaaacaaaaatttacttccaaatatacctaacataaacctaacccaaaaaaacaccacctcactaaaaactttacgaatatcaaaaacctcaaactcttcacaaaatcaaaactcaaaaaatatcttactaataaataaaactaataaaaacgacaaaactaaacctacccctaaaaaaaactccctacaaatcacatttcccaataaaacactaaacttatcaaaaaaatatatataataaacaaaaaaaaaaatacaatactatttctaaacccttataaaatcctatacaataaacacatacatatcacatttaactatactcaaaaaaactatcatcatcctacaactcacattaaaaaacatcctaacttttaaacacttttcaaacaatcaaattaactcacgtaaatcctaaaacctacaacacgtcgaatactaccccactataacaaaaaattataatcacaacttaataactacgaaaacctaccctccgtttttctactaaataaaaaaataataaaaatttaactactatcataacatccaaaactttatcgtatttaacacacaacaaaaacccaaatattaaaaaaactctattccaataaactataaaaactaccttataaataatttaaatatctcactaaaacataaaatataaatttttattattatacatacgatttaaaatatttaaaatattttcttctctataaaaaaatttattattaatacaaaatataataaaattatcgcaacccctctccttccaatataaccaactaaaattacaaatattaaatatttttcataaacaaattcgaatcaaaattaaaaattcataataaaattaatatctataaaataaatataaatttttaaaaaaaaaaatttaatattatcaaaaaaataaaaaaaaaaatactatttaaaatataaaaattacaatccaaaatactattctttccaaactatatataaaatacataataaaaattatttaataatattacatttatttatccaaaaaactataatttcaaaaaaacctaacatactaataaatattttcaactttttccctcactaattaatacttttaaaaacataacataaattttttaaaatctttaataaataacccataattaaaatatataatataaaaaattttaaaaatctaaacaacttattatttctctaaaaatatatataattttactttcctaaaaaattaccaaaaatatcctttaaaatttaaaaaaataacaaattacatcaaaaaactttattttaaaatataaaaaaattcccaaacgtaattacattaaccattcatatatatcaaaaatacaaaattaaaacacttaataatcaccttataacaattttatataactcccaataatactatacacatatttaaaaaatctttctcaaaaaaatattaaacatattttattactcaatatttttataaattacttaattataattaaattctaaacctaatattaatataattttaaaaaacaattataccaaataaaattattttaaaaattataataaatatatacattcaa

SEQ ID NO: 60 - DNA, 14238 bp, Artificial Sequence
  bisulfite converted genomic DNA
ttgaatgtatatatttattataatttttaaaataattttatttggtataattgttttttaaaattatattaatattaggtttagaatttaattataattaagtaatttataaaaatattgagtaataaaatatgtttaatatttttttgagaaagattttttaaatatgtgtatagtattattgggagttatataaaattgttataaggtgattattaagtgttttaattttgtatttttgatatatatgaatggttaatgtaattacgtttgggaatttttttatattttaaaataaagttttttgatgtaatttgttatttttttaaattttaaaggatatttttggtaattttttaggaaagtaaaattatatatatttttagagaaataataagttgtttagatttttaaaattttttatattatatattttaattatgggttatttattaaagattttaaaaaatttatgttatgtttttaaaagtattaattagtgagggaaaaagttgaaaatatttattagtatgttaggtttttttgaaattatagttttttggataaataaatgtaatattattaaataatttttattatgtattttatatatagtttggaaagaatagtattttggattgtaatttttatattttaaatagtatttttttttttatttttttgataatattaaatttttttttttaaaaatttatatttattttatagatattaattttattatgaatttttaattttgattcgaatttgtttatgaaaaatatttaatatttgtaattttagttggttatattggaaggagaggggttgcgataattttattatattttgtattaataataaatttttttatagagaagaaaatattttaaatattttaaatcgtatgtataataataaaaatttatattttatgttttagtgagatatttaaattatttataaggtagtttttatagtttattggaatagagtttttttaatatttgggtttttgttgtgtgttaaatacgataaagttttggatgttatgatagtagttaaatttttattatttttttatttagtagaaaaacggagggtaggttttcgtagttattaagttgtgattataattttttgttatagtggggtagtattcgacgtgttgtaggttttaggatttacgtgagttaatttgattgtttgaaaagtgtttaaaagttaggatgttttttaatgtgagttgtaggatgatgatagtttttttgagtatagttaaatgtgatatgtatgtgtttattgtataggattttataagggtttagaaatagtattgtatttttttttttgtttattatatatatttttttgataagtttagtgttttattgggaaatgtgatttgtagggagttttttttaggggtaggtttagttttgtcgtttttattagttttatttattagtaagatattttttgagttttgattttgtgaagagtttgaggtttttgatattcgtaaagtttttagtgaggtggtgtttttttgggttaggtttatgttaggtatatttggaagtaaatttttgtttttaaggttatttttattgaggtttggtagtgagaggtttggtaggagggtttgagatgtattgttgattttttttagttttcgggagatgaaggagcgagagtggtttgatatggtagaagatgttttttgattgtttgagtagtgttgttcggagcgttttttgcgggattcgttaatgcggtagaagaggtatttgattttttttattgttttattgagtattgttttttttaggaggatatatatttaggggtttaggatggggtttatagaagtaattcggatggtttgtaaatttggatttttattgatttttcgttttaaatttggttgatataattggttgacgaatattcgtatttgtataagtgagatcgtatatttagattttattattaattaattgggaaaatatataaatgttatgtttattttattaatattaggaagttgtttttatttttggtaataagttttaggaaaagaggaagttatataataagttttagaaaaattagttatgggttgggtacggtggtttacgtttgtaattttagtattttgggaggtcgaggtgggaggattatttgaggttaggagttcgagattaatttgtttaatatggcgaaattttatttttattaaaaatataaatattaggttgggtgcggtggtttacgtttgtaattttagtattttggtaggtcgaggtaggcggattattaggttaagagattgagaattttttggttaatatggtgaaattttatttttattaaaaatataaaaattagttgggtgtggtggtatgcgtttgtagttttagttattcgggaggttgaggtaggagaattatttgaatttgggaggcggaggttgtagtgagttgagattttattattgtattttagtttggcgatagagcgagatttcgttttaaaaaaataaaaattagttaggtgtggcggtatacgtttataattttagttatttaggagggtgaggtaggagaatggtttgaatgcggcgggtggaggttgtagtgagttgagatgatgttattgtattttagttagggtaatagagtaagaatttgtttaaaaataaaaaataaaaaaataaaaattagttattgtaaaaatgtaattatatgttttgagttcgtatagttttaatatttttgtaattattttatgattattttttttagagtaaagatagtatataaaaatgtaatgtgagtgtaggttatatatgtataaagtgtttttgagaagtattttattaattttatttttgtgagtgtttttaagtttttgtaattttaatgaagtaattttttttttttaaaagttattgattttttattttagttgttattttatataatttaaaggaaatttattttataagttaattaattatttaattattagaataaggttaagatttttttattttagtttagaaagaatatgttgaaaagttttatattaatagtaggattttttgttatttagaatgattagagaatagtttttattttttttatgattttgttttttagttatagtaattataacggatgaatgagaatttgttaaatttagaaggaaagatattatattttaaatagaggtagttttatgtgtaaagttatggaagaatgaaatgatatgttaatatttgggaattttaaatgatttagcgaatggagtatgaatttgtgtaaatttatatgattattttaatttttaggggaaaatgtatttgttaaatgtatatgtatatatatttttgagatagggttttattttgtcgtttaggttggagtgtagtggtgtaattattgtttattgtagttttgattttttaggttttagtaatttttttgttgtagttttttgagtagttgggattataggtgtgtgttattatgtttggttaattgttattatttttgtagagatgaggtttttttatgttgtttaggttggtttttaatttttgagtttaagtgatttgttcgttgtagttttttaaagtgttaaaattataggagtgagttattatgtttagttttaaatttatttttaaagtattatgatttttttttgtttagatattatttttaattttattgggattatttatataaaaattttatttgtaattaatatagaaatagtagtagtggtaatttatatagaaatagaaatagaaatagtagtatagaaataaaaataattgttatatattttaagtaattatttagtaattattttttgtttttagtaattattttaggttagggagaagaggttgagttttatagttaaggaagatatataaaaattataaaaaggagaaagaattaataaaagtatagttggagttatttaattaggggtaaatatttttaataagatttgaggatgttgttgttttattatatatagcgtaataatgaatgatttatggtgtatgaattatttggaatagggatagtttagttgaggttgagttagtttataacggaaaaggcgatttattgattatttgtatgtgtttttttggtatttattagatgtaataatatttgggttaggatattatagaaagatttttaataatttgggtaaaatttgggtaaaagaaggaagaattatttttttttttttttaaagattttttgaatttttaaaatattcgaagaaatatattttattaatttgtaaaattaagtttatattaaatttatttttggatgatattggattagtaaggtagaattgtattttttttttttttttaattggaatttagattttaattagttataggtttttgatttttttttaaaagatttttgtttattttttttgttattgttttgttgttatttatttgttttgttttgagaatttatatttattgtaaaatttgatttaaatttattttggtagtaaaattgaattgaatagattgtgaagttatttagtttaatttattttatttagagtgaatatttttatgttttggtttaggattattgttttagttttgatggggatattatatattttgtaatatattattgattatttttttaaaagttaagaaattttgaattttgaaatttatttgttcgtaaatattttggatatgggattatgggtttgtaaattttagagaataaaatagtgatatgtttttaattaagatgaaattaatatttttttatatggaagatagttaaattaagaatgaattagaatgaatagtagtgtgtaatatcgttttttgaaatatttttagaaattacgttgggataaatgatagtattaaggtaaagtatatttgatttaaaaaaaaatttttatagaaagtaaaataaagtattttggttttttttttttataagttttgaggtttttagttatgtttggaaatttagtagtttttttaattttataggtttttttttagatgaggtatttgttattgagatttagaggttttgaggaatttaggatgttttttattttgttggtggtagagtttggtttggatttttatgttgttttttttgttttattagtttggttttttgtttaattattattttttgataatggaattgttggtaaaaagtatgaggtttatattttatttatattatatattacgtttttaagggtagaagaaatgatggcgttaaatttgttagtattaagttttgtgtgtggtttttggaaaagatttacggtcgggtttatgcgaatttgagtttttaagtttttaggtggtagtgttgttttatttgagagtttttgatattatttttttaataagtattgtgtaaagttattttcgagattcgtagaatagaattttggttaagtttgaatttgacgtttttgagatttttgatattgaaaatgttttattgttggttgttttttttattataattttaaaggaaatatggttattattgaaaggaagaaaatttttgaatagttaaaatggaatttatagttatttaaagaagtatattaggagttagtattttaaaatttttgtggttttttagaaaggttggaatgttgtaaaataattaataataggtttttataattaaaggtgatgagaggtaaggaaagaattatttttgtgttttattttatttatagtagtaatggatttcgattagtataggagggaatgaaaggaggttatattaaaagtatgttttattttaaagttttttatgggggaggaaaagtttataattagtataagttattgaatttggttatttaatgtttttttaataaaggggagtttatagggtagtaaaagtatgagtttaaaaagtaaaagtttaaatttaggtaaaaatatttttaaaagttggttagattgaaaagaattaatatgagttttattttgtagcgtattttaattgagatttattttaagtagggaaagaaaaaagataaaataaataaaaattttacgtattttgtaatgtttgaaaatatagagtaatttttgttttattttaagtaggttatttgatttgttgtttttaagagggtagggataattttagttgagatggggatattcggagtagtgttttaatgtttcgtgagggggtgaaagtatttttcggaatttttgtttaataggttttatattttatataattaaataagtttaggtagtttttagtgttggaagagtgtgttgttgataaaattgaattttcgagttaggagggaatatggtcgggtatggtggtttatgtttgtaattttagtattttgggaggttgaggtaggcggattatttgaggttaggagtttgagattagtttgattaatatggagaaatttagtttttattaaaaatataaaattagtcgggcgtggtggtgtatgtttataattttagttatttggaaggttgaggtaggagaattatttgaattcgggaggtggaggttgcggtgagttgagattgcgttattgtattttagtttgggttataaagtgaaatttcgttttaaaataaaaataaaaataaaaataaaaataaaaaaatttattgaatataaataacgtatttttttttttttaattttaagtttttttttagtagtttttgttgtgtatatgtggtttgttgttaatattggtatattatagtattttaaattattttatttttttttagaaagggttttattttgttatttaggttggagtgttgtgatataaatatggtttattgtagttttaattttttgggtttaagtaattttttagttttaattttttaagttgttgggattataggtatatgttattatatttatttaattttttttaaattatgttatttatatttttttttaggatgattagagattagggtttaggagtagtggaatataattttgaggaaatgtaataagtttagaagaagatgtggtgataagaaagttgtaaggaggttatatgttgtagagataaatgtttaagttttggaagtaaataagtttttgtttaaattttggttttgtttttataacgtatgtataaattattaaagtgtttagtatagtgtttatcgtataatagatatgttggtttttattatttttttttttaatttatatgtggaagtttgtttagtgtggaaggtattaataatttgaaaattgtagtttagaggtagttttgggatatagttaataatatggtattaaaaatatgtattttttatttaataatttgtttgtagggaatgttgaagaaagaatgttgaatttttgattagatttagtaatggattgttaaaatagtaacgttttttaataagtgataagatttgtagttggatttgaatgtgtgtgttatttgttttgttttaagtatataaaaggaattatttgtatgggtttagttattttattgttttgttaagagtttaaaattgatatagttgttattagaagtttttattatttttttttttttaagtaaagaatagtggaaataattattgattgggtggtgtgtaggagagtttggttttttttttggttatttgtagaaggtaagttaaatttttataggttttataggttaatttttatattgaaagtttttgtttttttttatttgtttgtttttaaagtttttatattgaatattttgataggagattataagaattacgttagggttgagaaaaaaaattttgttaggagatatttaatataaataaattgataggttaagaaagtatggtgaaatgagtattagacgaggatttatttatagttattttgtaagttgtagaatgatataaattttttatttgtagtttgggaaattgaggtgtagagagagtgaaaatattggttagttttattttttttttagagttttttaagatttaaatgaaatgttagatgtggaaataatttatttttatgttatttaatagtttttaggttattattattgggtttgtaattgtatgttatgatttaaaatttttttttaggtattgtaattttttaaatttagttaaatttatttgaataaatttagttttttagattttgttatagttatatttaaatttgtggtattttttttgtatgtatagatgtgttttatatttatttgatattttattagttgttttatgattttatttttagtttgtttatagtaaataaaagtatatttatttataaagtttttatttgtttttataaatttttgttgattaaatgttggtgaaagttttatagagataattagtttatagtaaggaattaaataaatagttataggaagtatttttttaaggatttaagttttattttattaaggtagaagattaattaaattagttgttttgtttttagttgagatgagtatttgttattttagagttaaaaaataaaagaaataagtaagtaataaatatagttttgggttgtttgtgtatgggggaaaatgattttcgaaattttatagtaattgtttagttttaaggtaaaatatttgattataataattattttaatatttattagtaattgtaaaattaggtattagtaatttattaagttatagtatttaaaattaggattttaggaggttgttttgtttgtatatttttaaagaatttaatttttttcgtttattttaaatgtagatttttattttttgtttttataaaattttagaagtttttatttttaaaatttttttatatttaaaaaaattatgagattggttataaatagaagaatggataaaatgataagaattatttatttattaaattttgttatgtgatgttttttgtagattatatttatattttttttgattattaattatgatttagtttaaagaatgttgtaggtttagtatagttttttatatttataattaattttttaattttttttaaatttttattttaattttaattttatttatgaaatatgtatattttggatagtaaattaaaatttattttttatattaaatttaatattaatttttttttaagagttgtagtttttttttttttggtgtttaggaggtaaaattttggttgttttttagtggttgtttgttttttttaggtattatattaagttttttgaaattttaagtaaattatatttgttttgttagtttttttaaagtatttaaaatgattttaacgttttgattttttttaaatgggattagtaattatttgatttgataaaattagatgttttattagtttttttggaattgaagataagtttaattgtttttaatgttagagagttttgagttttaattttaatttataatatgaatatgaaaatatgaaaaaagaaagttgtaaaaggaagttaaggaagattgtatttgcggaagggtttttgattattttagtaattgttgaattgtgggggggggggtgggtgggtggtataatgaatttattatttattattaatttataattaaattgattttgaaattagattttagtagttaaaattaaaggcgataaattgatgttattgttattttaggattttttattttttataaagttatataaatatttgattaatgggattattttttaattgagttagttttaatttttaggttaagattatttaaaatttattatacgttattaatattatataggtggatagtattttttgttagttaaaatgtggttaatttgtaaattataaatatagtttttataattttttgtttttaggtttttaaataattttaaggttttgtgtaagggttttgaattttaggtttaggtttattattttagtttatgaggtgaattaagttttgtatgtttttttagatgttggaagaaaataatttattcgtggttgtgtagaaatttatagttttatatgtttatttttaattaaaatatatttataaagtatgtgtatgttgttaattttttagttttaatttttttgtttttttaagtggatgttttgaaaataataattatttattttgttatttattgttttgtaaaatataaggtagaggtttaggaataggggttttattaggagtagtgttgttttttttaaaattttattttattttaggttgttattatagatagtaaaatatatttatgtggtttaagtgtgatttaattttgtaaattatattgggttttggaatggtttaaaggtttttatggtttattatatttatttttgtttatataaattggtaagaatttattgtattttggttttgagttttttttaagttttttttatttatagttatttttattaaagatatatttttatattaaagatttttggatagtattaataaggaaaaggaaggaataatagtttattatattttatatttttttgtttttaataagtataagaaaaagtagttatttttttttgagttggtagtttagaatttttaggaatgtagtgttttggaagatggaagaatttataattagttgtttttaagagaaattttagataaagtattgtattattttgtttatttgtttttggtgtattttattttagttataggtaaagtagaaaattaggtagggtttgagtttttttgtttattatattttaaaagttaatttaaaggtaatttttaaaagatgaattaaaaatgaagtgtattaaaattttaatttacgttttataaacgttaaaatgagaaatgttttacgagggagacgtgatgtaataatatatgagttgggtttggttttagacggtttaaggtttattataagttgtagagttttggtttgaagaaataaagatagttatttttaaatttcggtttttttaaaatggtattgtatttcgtatagttgtcgagaatttaaattttatattttatgtatattagtttgtttataattagttattttgagaaattttgtttttttggtttagatagaatgaaagaaattgagtttggattttgttttgtatatgaattagaatttgtgtgttttaagttgtttttttagggtatattatggtaaagagtagggagtttagtttgattgtgtaggttcggttggattattttaagcgtattatttatttttttagtgaagtgagggagttagattaaaatattttttgatattttttttagttttaaaattttacgtaatttacgggggaagaaatttaagaaattttgtatatattaaaatattaaaaattttattttttttaaaaatggtttataacgaatagattattatttttgatattttaggttttgtagtttatagtttatagtacggaggaatgggttaagttatattatagtaggtttttttttacgtttaatagagggggcggggggtttttttggaagattcggttagtgttaggtagtaaggggtaagggttgtttcggtggagaaagaaatttaggttttcgggaatataaattgggggatgtaggggtaaagtatttgttaaatttcgttagggttgggattttaaagagggttgggtttgttttgagaaatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatggttatcgggtttattaataaagtgtttaataggtcggtgatagttagtttatatattagcgtgtagaaggtcgtttttttttgttttttgcgcgatttgtatagtattacgatggttattaggttgtttattatttcgaagatgaatattatcgtcgggatggttattgggttgtttagtcggtcggggtttaaggaggcggacgaattgatttcgggagtggatatgatagtggttggcggtgcgtagttttggagtgtaaggttgggtttggggatggtagaagagagataaagttgtcgtgagcggaaattattatttgtaaggtgttagattcgcgttcgagaaacgatatattgataagataaggggagtaattcgattttattttttggattgtagttatttattaattgcggttattaaaatttttaggttcgcgatacgttttgttaatagtatatttttgttgatattaatatttataaattgatttttttatttttttttttttttataatttaatttattttattgttaagatgaataagatttattttaagggaaaagtagttcgttagtgttattttcgatagattttgaattaataaaatgtttattgaaaataagttataaaagtaatttggagagcgcgtttttttttttttggtttttttcggcgagggtcgtatttttgcgttttttattcgttgattttaacgttagtttaacgttattttatttgtagcggtagtagcggtggtagttttacgagtttttagggttagtttttagatgttttggattcgtttttaatttgtttttattttgttttgtttagtttggaaattgttaaattttcggttttttaaagtcggttttagtggttgtcgatttttggatatcgaggttagagttgttagtttttaaaaatttgggaaataagaggtgtagcgggatgggttagtgaagaatggtgttggattttttattcgttatttttttttttttaaagacgagttttagttttgtagtgttcgtcggtttcgtttgcgggaggatagcgtttaggtgtgaggttgtgcgcgtaggtggcgcggagttttggtttttagttttggttgtttttcgttttagttacgggtagtacgggcggttattggagtttgcggttgtcgttgaggtcgtttttggttatttgggggcggttcggggtttattttgttagaggttttggtttggggttgtttatttttttttcgggttgtcgggtttggagtttcgttttcgtttttttattttttgtataaatttttttttttttttaagtttttttggcggaggcggaggtaaatcgcgcgttgttcgggcgtttattggtcggattggaagggggcggagcgcgttttttttgggcgtcgtagggaagattggcggggggcggtgtttgggttggggcggggttgggcgcgcggggtggggcggttttcgtggtttttacgttttcggaggtgcggagtgggaattcggaggggattttgggaagtttcggtgtttttttcggcgatcgtttagtcgtttttgaattcggtttttagtggggttattattgaaatcggcgatcgttttcgtttcgttgtttgtcgttcggagtgtattattttttgaattttttgttcgcgggtcgtaatatttagatcgtggaagagagggtagttgtttt

SEQ ID NO: 61 - DNA, 2021 bp, Homo sapiens
gagatggcgttgggctgacgttggggtcaacgggtagagaacgcagggatgcggccctcgccgaagagagccaagaagggaagagcgcgctctccaaattgcttttgtaacttgttttcagtgagcattttattgattcagaatctatcgagaatagcactagcgagctacttttcccttgagatgggtcttattcatcttggcaatggagtgagttggattgtggggaggaagaggaatgggaaaatcagtttataaatattaatgtcagcaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgcaaaacctgaaatgtcagggatggtgatctgttcgttgtaaaccatttttaaggaaagtggggtttttggtgttttgatgtatgcaaggtttcttgaatttcttcccccgtggattgcgtagaattttaaagctagaagagatatcaagaggtgttttagtctaactccctcacttcactgagggagtgaatgatacgcttaaaataatccagccgaacctacacagtcaagctaggctccctgctcttt

SEQ ID NO: 62 - DNA, 2021 bp, Artificial Sequence
  bisulfite converted genomic DNA
gagatggcgttgggttgacgttggggttaacgggtagagaacgtagggatgcggttttcgtcgaagagagttaagaagggaagagcgcgttttttaaattgtttttgtaatttgtttttagtgagtattttattgatttagaatttatcgagaatagtattagcgagttattttttttttgagatgggttttatttattttggtaatggagtgagttggattgtggggaggaagaggaatgggaaaattagtttataaatattaatgttagtaagagtgtgttgttggtaggacgtatcgcgagtttggagattttggtggtcgtagttggtaagtggttataatttagaaagtaggatcgagttgttttttttgttttattagtgtatcgtttttcgggcgcgggtttaatattttataagtggtaattttcgtttacggtagttttgttttttttttattatttttagatttagttttgtattttaaggttgcgtatcgttagttattattatgtttattttcggggttaattcgttcgtttttttgagtttcgatcggttgaatagtttagtgattatttcggcggtgatgtttattttcggggtggtgggtaatttggtggttatcgtggtgttgtgtaagtcgcgtaaggagtagaaggagacgattttttatacgttggtatgtgggttggttgttatcgatttgttgggtattttgttggtgagttcggtgattatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgttttttagagtaggtttaattttttttgaagttttaattttaacgagatttagtaggtgttttgtttttatattttttagtttatgttttcggaagtttgggtttttttttttatcgagatagtttttattttttgttgtttgatattggtcgagttttttaagaaaatttttcgttttttttgttagacgtggaggggagtttgttgtagtgtgatttagtttattttttcgtattgtgaattgtgaattgtaaaatttgaaatgttagggatggtgatttgttcgttgtaaattatttttaaggaaagtggggtttttggtgttttgatgtatgtaaggttttttgaattttttttttcgtggattgcgtagaattttaaagttagaagagatattaagaggtgttttagtttaatttttttattttattgagggagtgaatgatacgtttaaaataatttagtcgaatttatatagttaagttaggttttttgtttttt

SEQ ID NO: 63 - DNA, 2021 bp, Artificial Sequence
  bisulfite converted genomic DNA
aaaaaacaaaaaacctaacttaactatataaattcgactaaattattttaaacgtatcattcactccctcaataaaataaaaaaattaaactaaaacacctcttaatatctcttctaactttaaaattctacgcaatccacgaaaaaaaaaattcaaaaaaccttacatacatcaaaacaccaaaaaccccactttccttaaaaataatttacaacgaacaaatcaccatccctaacatttcaaattttacaattcacaattcacaatacgaaaaaataaactaaatcacactacaacaaactcccctccacgtctaacaaaaaaaacgaaaaattttcttaaaaaactcgaccaatatcaaacaacaaaaaataaaaactatctcgataaaaaaaaaaacccaaacttccgaaaacataaactaaaaaatataaaaacaaaacacctactaaatctcgttaaaattaaaacttcaaaaaaaattaaacctactctaaaaaacaatataaaaatcccaaccccgacctaaaaacgacacgttcactaccaaaaactcaaaaaaaaaacaaaaaacgaaaaataaacgcgaaaaataaatacgaaaaaaaaaccgaataaaaccccaaccccgatcactcaccacgaacgaaataaaacaaataaacaccaccaaaaaaataacaataaataaaataaccatctaaatctcgacgcccgcgatacgacgaaaactccgacgacgccgaaaatcgctaaaacgcgacaaaactaaaaaaacaacgaaataaccccgaaaaacaaccgaaacgaccgcgaccgcgtaatactactcgatacccaacgaaatacgacgcataaactaacgatacatacgaaacaacgcgccgcacacaaacacgttacaaaaaacgataacgaaaataaaaaaaaaactaaaacccgcgtacatataaaaataaacgacgtacgccgtcacgttaataatccaatcgataaaacaccaaatatctaaatactacaaccgcgaactaccgaaacccatattaaacaacgcgcaaaaaaacacgttaaacgcataaactacaaaaaacgtaaaacccgccaatcgcttatccacgtaataactataaaaataaacataattaataaccaaataacgctcgacactcataacgcaaataatactaaaaccgaacaaactaaaaaaaaacaaaataaaaatactatactcgcacaacgactaacccccgaaccattaacccttcatatacgtaacgataatcaccgaactcaccaacaaaatacccaacaaatcgataacaaccaacccacataccaacgtataaaaaatcgtctccttctactccttacgcgacttacacaacaccacgataaccaccaaattacccaccaccccgaaaataaacatcaccgccgaaataatcactaaactattcaaccgatcgaaactcaaaaaaacgaacgaattaaccccgaaaataaacataataataactaacgatacgcaaccttaaaatacaaaactaaatctaaaaataataaaaaaaaaacaaaactaccgtaaacgaaaattaccacttataaaatattaaacccgcgcccgaaaaacgatacactaataaaacaaaaaaaacaactcgatcctactttctaaattataaccacttaccaactacgaccaccaaaatctccaaactcgcgatacgtcctaccaacaacacactcttactaacattaatatttataaactaattttcccattcctcttcctccccacaatccaactcactccattaccaaaataaataaaacccatctcaaaaaaaaaataactcgctaatactattctcgataaattctaaatcaataaaatactcactaaaaacaaattacaaaaacaatttaaaaaacgcgctcttcccttcttaactctcttcgacgaaaaccgcatccctacgttctctacccgttaaccccaacgtcaacccaacgccatctc

SEQ ID NO: 64 - DNA, 2021 bp, Artificial Sequence
  bisulfite converted genomic DNA
aaaataacgttaaactaacgttaaaatcaacgaataaaaaacgcaaaaatacgaccctcgccgaaaaaaaccaaaaaaaaaaaaacgcgctctccaaattacttttataacttattttcaataaacattttattaattcaaaatctatcgaaaataacactaacgaactacttttcccttaaaataaatcttattcatcttaacaataaaataaattaaattataaaaaaaaaaaaaaataaaaaaatcaatttataaatattaatatcaacaaaaatatactattaacaaaacgtatcgcgaacctaaaaattttaataaccgcaattaataaataactacaatccaaaaaataaaatcgaattactccccttatcttatcaatatatcgtttctcgaacgcgaatctaacaccttacaaataataatttccgctcacgacaactttatctctcttctaccatccccaaacccaaccttacactccaaaactacgcaccgccaaccactatcatatccactcccgaaatcaattcgtccgcctccttaaaccccgaccgactaaacaacccaataaccatcccgacgataatattcatcttcgaaataataaacaacctaataaccatcgtaatactatacaaatcgcgcaaaaaacaaaaaaaaacgaccttctacacgctaatatataaactaactatcaccgacctattaaacactttattaataaacccgataaccatcgccacgtacataaaaaaccaataacccgaaaaccaaccgctatacgaatacaacaccttcattctactcttcttcaacctatccgacctcaacatcatctacgccataaatatcgaacgctacctaaccatcaaccatacctatttctacaaccactacgtaaacaaacgattaacgaacctcacgctctttacaatctatacgtccaacgtactcttttacgcgctacccaacataaatctcgataactcgcgactacaatacccaaacacctaatacttcatcgactaaaccaccaacgtaacgacgcacgccgcctactcctacatatacgcgaacttcaactccttcctcattctcgccaccgtcctctacaacgtacttatatacgacgcgctactccgcatacaccgccaattcatacgccgcacctcgctaaacaccgaacaacaccacgcgaccgcgaccgcctcgattacctcccgaaaccaccccgctacctccccaaccttaccgcgcctcaacgactttcgacgccgccgaaacttccgccgcatcgcgaacgccgaaatccaaataatcatcttactcattaccacctccctaataatactcatctactccatcccgctcgtaataaataaccgaaactaaaaccctactcgacctttttctcgcatccacctcccgcgtccattccccgctccctactttccctctaaatccttaacaataaacgtatcgcctttaaatcgaaactaaaattcccacactatttctcaaaacaaacccaaccctctttaaaatcccaaccctaacgaaatttaacaaatactttacccctacatcccccaatttatattcccgaaaacctaaatttctttctccaccgaaacaacccttaccccttactacctaacactaaccgaatcttccaaaaaaaccccccgccccctctattaaacgtaaaaaaaaacctactataatataacttaacccattcctccgtactataaactataaactacaaaacctaaaatatcaaaaataataatctattcgttataaaccatttttaaaaaaaataaaatttttaatattttaatatatacaaaatttcttaaatttcttcccccgtaaattacgtaaaattttaaaactaaaaaaaatatcaaaaaatattttaatctaactccctcacttcactaaaaaaataaataatacgcttaaaataatccaaccgaacctacacaatcaaactaaactccctactcttt

SEQ ID NO: 65 - DNA, 2021 bp, Artificial Sequence
  bisulfite converted genomic DNA
aaagagtagggagtttagtttgattgtgtaggttcggttggattattttaagcgtattatttatttttttagtgaagtgagggagttagattaaaatattttttgatattttttttagttttaaaattttacgtaatttacgggggaagaaatttaagaaattttgtatatattaaaatattaaaaattttattttttttaaaaatggtttataacgaatagattattatttttgatattttaggttttgtagtttatagtttatagtacggaggaatgggttaagttatattatagtaggtttttttttacgtttaatagagggggcggggggtttttttggaagattcggttagtgttaggtagtaaggggtaagggttgtttcggtggagaaagaaatttaggttttcgggaatataaattgggggatgtaggggtaaagtatttgttaaatttcgttagggttgggattttaaagagggttgggtttgttttgagaaatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatggttatcgggtttattaataaagtgtttaataggtcggtgatagttagtttatatattagcgtgtagaaggtcgtttttttttgttttttgcgcgatttgtatagtattacgatggttattaggttgtttattatttcgaagatgaatattatcgtcgggatggttattgggttgtttagtcggtcggggtttaaggaggcggacgaattgatttcgggagtggatatgatagtggttggcggtgcgtagttttggagtgtaaggttgggtttggggatggtagaagagagataaagttgtcgtgagcggaaattattatttgtaaggtgttagattcgcgttcgagaaacgatatattgataagataaggggagtaattcgattttattttttggattgtagttatttattaattgcggttattaaaatttttaggttcgcgatacgttttgttaatagtatatttttgttgatattaatatttataaattgatttttttatttttttttttttttataatttaatttattttattgttaagatgaataagatttattttaagggaaaagtagttcgttagtgttattttcgatagattttgaattaataaaatgtttattgaaaataagttataaaagtaatttggagagcgcgtttttttttttttggtttttttcggcgagggtcgtatttttgcgttttttattcgttgattttaacgttagtttaacgttatttt

SEQ ID NO: 66 - DNA, 1096 bp, Homo sapiens
catcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgcaaaacctgaaatgtcagggatggtgatctgttcgttgtaaaccatttttaaggaaagtggggtt

SEQ ID NO: 67 - DNA, 1096 bp, Artificial Sequence
  bisulfite converted genomic DNA
tatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgttttttagagtaggtttaattttttttgaagttttaattttaacgagatttagtaggtgttttgtttttatattttttagtttatgttttcggaagtttgggtttttttttttatcgagatagtttttattttttgttgtttgatattggtcgagttttttaagaaaatttttcgttttttttgttagacgtggaggggagtttgttgtagtgtgatttagtttattttttcgtattgtgaattgtgaattgtaaaatttgaaatgttagggatggtgatttgttcgttgtaaattatttttaaggaaagtggggtt

SEQ ID NO: 68 - DNA, 1096 bp, Artificial Sequence
  bisulfite converted genomic DNA
aaccccactttccttaaaaataatttacaacgaacaaatcaccatccctaacatttcaaattttacaattcacaattcacaatacgaaaaaataaactaaatcacactacaacaaactcccctccacgtctaacaaaaaaaacgaaaaattttcttaaaaaactcgaccaatatcaaacaacaaaaaataaaaactatctcgataaaaaaaaaaacccaaacttccgaaaacataaactaaaaaatataaaaacaaaacacctactaaatctcgttaaaattaaaacttcaaaaaaaattaaacctactctaaaaaacaatataaaaatcccaaccccgacctaaaaacgacacgttcactaccaaaaactcaaaaaaaaaacaaaaaacgaaaaataaacgcgaaaaataaatacgaaaaaaaaaccgaataaaaccccaaccccgatcactcaccacgaacgaaataaaacaaataaacaccaccaaaaaaataacaataaataaaataaccatctaaatctcgacgcccgcgatacgacgaaaactccgacgacgccgaaaatcgctaaaacgcgacaaaactaaaaaaacaacgaaataaccccgaaaaacaaccgaaacgaccgcgaccgcgtaatactactcgatacccaacgaaatacgacgcataaactaacgatacatacgaaacaacgcgccgcacacaaacacgttacaaaaaacgataacgaaaataaaaaaaaaactaaaacccgcgtacatataaaaataaacgacgtacgccgtcacgttaataatccaatcgataaaacaccaaatatctaaatactacaaccgcgaactaccgaaacccatattaaacaacgcgcaaaaaaacacgttaaacgcataaactacaaaaaacgtaaaacccgccaatcgcttatccacgtaataactataaaaataaacataattaataaccaaataacgctcgacactcataacgcaaataatactaaaaccgaacaaactaaaaaaaaacaaaataaaaatactatactcgcacaacgactaacccccgaaccattaacccttcatatacgtaacgata

SEQ ID NO: 69 - DNA, 1096 bp, Artificial Sequence
  bisulfite converted genomic DNA
catcgccacgtacataaaaaaccaataacccgaaaaccaaccgctatacgaatacaacaccttcattctactcttcttcaacctatccgacctcaacatcatctacgccataaatatcgaacgctacctaaccatcaaccatacctatttctacaaccactacgtaaacaaacgattaacgaacctcacgctctttacaatctatacgtccaacgtactcttttacgcgctacccaacataaatctcgataactcgcgactacaatacccaaacacctaatacttcatcgactaaaccaccaacgtaacgacgcacgccgcctactcctacatatacgcgaacttcaactccttcctcattctcgccaccgtcctctacaacgtacttatatacgacgcgctactccgcatacaccgccaattcatacgccgcacctcgctaaacaccgaacaacaccacgcgaccgcgaccgcctcgattacctcccgaaaccaccccgctacctccccaaccttaccgcgcctcaacgactttcgacgccgccgaaacttccgccgcatcgcgaacgccgaaatccaaataatcatcttactcattaccacctccctaataatactcatctactccatcccgctcgtaataaataaccgaaactaaaaccctactcgacctttttctcgcatccacctcccgcgtccattccccgctccctactttccctctaaatccttaacaataaacgtatcgcctttaaatcgaaactaaaattcccacactatttctcaaaacaaacccaaccctctttaaaatcccaaccctaacgaaatttaacaaatactttacccctacatcccccaatttatattcccgaaaacctaaatttctttctccaccgaaacaacccttaccccttactacctaacactaaccgaatcttccaaaaaaaccccccgccccctctattaaacgtaaaaaaaaacctactataatataacttaacccattcctccgtactataaactataaactacaaaacctaaaatatcaaaaataataatctattcgttataaaccatttttaaaaaaaataaaatt

SEQ ID NO: 70 - DNA, 1096 bp, Artificial Sequence
  bisulfite converted genomic DNA
aattttattttttttaaaaatggtttataacgaatagattattatttttgatattttaggttttgtagtttatagtttatagtacggaggaatgggttaagttatattatagtaggtttttttttacgtttaatagagggggcggggggtttttttggaagattcggttagtgttaggtagtaaggggtaagggttgtttcggtggagaaagaaatttaggttttcgggaatataaattgggggatgtaggggtaaagtatttgttaaatttcgttagggttgggattttaaagagggttgggtttgttttgagaaatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatg

SEQ ID NO: 71 - DNA, 1083 bp, Homo sapiens
gagatggcgttgggctgacgttggggtcaacgggtagagaacgcagggatgcggccctcgccgaagagagccaagaagggaagagcgcgctctccaaattgcttttgtaacttgttttcagtgagcattttattgattcagaatctatcgagaatagcactagcgagctacttttcccttgagatgggtcttattcatcttggcaatggagtgagttggattgtggggaggaagaggaatgggaaaatcagtttataaatattaatgtcagcaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggc

SEQ ID NO: 72 - DNA, 1083 bp, Artificial Sequence
  bisulfite converted genomic DNA
gagatggcgttgggttgacgttggggttaacgggtagagaacgtagggatgcggttttcgtcgaagagagttaagaagggaagagcgcgttttttaaattgtttttgtaatttgtttttagtgagtattttattgatttagaatttatcgagaatagtattagcgagttattttttttttgagatgggttttatttattttggtaatggagtgagttggattgtggggaggaagaggaatgggaaaattagtttataaatattaatgttagtaagagtgtgttgttggtaggacgtatcgcgagtttggagattttggtggtcgtagttggtaagtggttataatttagaaagtaggatcgagttgttttttttgttttattagtgtatcgtttttcgggcgcgggtttaatattttataagtggtaattttcgtttacggtagttttgttttttttttattatttttagatttagttttgtattttaaggttgcgtatcgttagttattattatgtttattttcggggttaattcgttcgtttttttgagtttcgatcggttgaatagtttagtgattatttcggcggtgatgtttattttcggggtggtgggtaatttggtggttatcgtggtgttgtgtaagtcgcgtaaggagtagaaggagacgattttttatacgttggtatgtgggttggttgttatcgatttgttgggtattttgttggtgagttcggtgattatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggt

SEQ ID NO: 73 - DNA, 1083 bp, Artificial Sequence
  bisulfite converted genomic DNA
acccgcgtacatataaaaataaacgacgtacgccgtcacgttaataatccaatcgataaaacaccaaatatctaaatactacaaccgcgaactaccgaaacccatattaaacaacgcgcaaaaaaacacgttaaacgcataaactacaaaaaacgtaaaacccgccaatcgcttatccacgtaataactataaaaataaacataattaataaccaaataacgctcgacactcataacgcaaataatactaaaaccgaacaaactaaaaaaaaacaaaataaaaatactatactcgcacaacgactaacccccgaaccattaacccttcatatacgtaacgataatcaccgaactcaccaacaaaatacccaacaaatcgataacaaccaacccacataccaacgtataaaaaatcgtctccttctactccttacgcgacttacacaacaccacgataaccaccaaattacccaccaccccgaaaataaacatcaccgccgaaataatcactaaactattcaaccgatcgaaactcaaaaaaacgaacgaattaaccccgaaaataaacataataataactaacgatacgcaaccttaaaatacaaaactaaatctaaaaataataaaaaaaaaacaaaactaccgtaaacgaaaattaccacttataaaatattaaacccgcgcccgaaaaacgatacactaataaaacaaaaaaaacaactcgatcctactttctaaattataaccacttaccaactacgaccaccaaaatctccaaactcgcgatacgtcctaccaacaacacactcttactaacattaatatttataaactaattttcccattcctcttcctccccacaatccaactcactccattaccaaaataaataaaacccatctcaaaaaaaaaataactcgctaatactattctcgataaattctaaatcaataaaatactcactaaaaacaaattacaaaaacaatttaaaaaacgcgctcttcccttcttaactctcttcgacgaaaaccgcatccctacgttctctacccgttaaccccaacgtcaacccaacgccatctc

SEQ ID NO: 74 - DNA, 1083 bp, Artificial Sequence
  bisulfite converted genomic DNA
aaaataacgttaaactaacgttaaaatcaacgaataaaaaacgcaaaaatacgaccctcgccgaaaaaaaccaaaaaaaaaaaaacgcgctctccaaattacttttataacttattttcaataaacattttattaattcaaaatctatcgaaaataacactaacgaactacttttcccttaaaataaatcttattcatcttaacaataaaataaattaaattataaaaaaaaaaaaaaataaaaaaatcaatttataaatattaatatcaacaaaaatatactattaacaaaacgtatcgcgaacctaaaaattttaataaccgcaattaataaataactacaatccaaaaaataaaatcgaattactccccttatcttatcaatatatcgtttctcgaacgcgaatctaacaccttacaaataataatttccgctcacgacaactttatctctcttctaccatccccaaacccaaccttacactccaaaactacgcaccgccaaccactatcatatccactcccgaaatcaattcgtccgcctccttaaaccccgaccgactaaacaacccaataaccatcccgacgataatattcatcttcgaaataataaacaacctaataaccatcgtaatactatacaaatcgcgcaaaaaacaaaaaaaaacgaccttctacacgctaatatataaactaactatcaccgacctattaaacactttattaataaacccgataaccatcgccacgtacataaaaaaccaataacccgaaaaccaaccgctatacgaatacaacaccttcattctactcttcttcaacctatccgacctcaacatcatctacgccataaatatcgaacgctacctaaccatcaaccatacctatttctacaaccactacgtaaacaaacgattaacgaacctcacgctctttacaatctatacgtccaacgtactcttttacgcgctacccaacataaatctcgataactcgcgactacaatacccaaacacctaatacttcatcgactaaaccaccaacgtaacgacgcacgccgcctactcctacatatacgcgaac

SEQ ID NO: 75 - DNA, 1083 bp, Artificial Sequence
  bisulfite converted genomic DNA
gttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatggttatcgggtttattaataaagtgtttaataggtcggtgatagttagtttatatattagcgtgtagaaggtcgtttttttttgttttttgcgcgatttgtatagtattacgatggttattaggttgtttattatttcgaagatgaatattatcgtcgggatggttattgggttgtttagtcggtcggggtttaaggaggcggacgaattgatttcgggagtggatatgatagtggttggcggtgcgtagttttggagtgtaaggttgggtttggggatggtagaagagagataaagttgtcgtgagcggaaattattatttgtaaggtgttagattcgcgttcgagaaacgatatattgataagataaggggagtaattcgattttattttttggattgtagttatttattaattgcggttattaaaatttttaggttcgcgatacgttttgttaatagtatatttttgttgatattaatatttataaattgatttttttatttttttttttttttataatttaatttattttattgttaagatgaataagatttattttaagggaaaagtagttcgttagtgttattttcgatagattttgaattaataaaatgtttattgaaaataagttataaaagtaatttggagagcgcgtttttttttttttggtttttttcggcgagggtcgtatttttgcgttttttattcgttgattttaacgttagtttaacgttatttt

SEQ ID NO: 76 - DNA, 1066 bp, Homo sapiens
tgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgcaaaacctgaaatgtcagggatggtgatctgttcgttgtaaaccatttttaaggaaagtggggtttttggtgttttgatgtatgcaaggtttcttgaatttcttcccccgtggattgcgtagaattttaaagctagaagagatatcaagaggtgttttagtctaactccctcacttcactgagggagtgaatgatacgcttaaaataatccagccgaacctacacagtcaagctaggctccctgctcttt

SEQ ID NO: 77 - DNA, 1066 bp, Artificial Sequence
  bisulfite converted genomic DNA
tgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgttttttagagtaggtttaattttttttgaagttttaattttaacgagatttagtaggtgttttgtttttatattttttagtttatgttttcggaagtttgggtttttttttttatcgagatagtttttattttttgttgtttgatattggtcgagttttttaagaaaatttttcgttttttttgttagacgtggaggggagtttgttgtagtgtgatttagtttattttttcgtattgtgaattgtgaattgtaaaatttgaaatgttagggatggtgatttgttcgttgtaaattatttttaaggaaagtggggtttttggtgttttgatgtatgtaaggttttttgaattttttttttcgtggattgcgtagaattttaaagttagaagagatattaagaggtgttttagtttaatttttttattttattgagggagtgaatgatacgtttaaaataatttagtcgaatttatatagttaagttaggttttttgtttttt

SEQ ID NO: 78 - DNA, 1066 bp, Artificial Sequence
  bisulfite converted genomic DNA
aaaaaacaaaaaacctaacttaactatataaattcgactaaattattttaaacgtatcattcactccctcaataaaataaaaaaattaaactaaaacacctcttaatatctcttctaactttaaaattctacgcaatccacgaaaaaaaaaattcaaaaaaccttacatacatcaaaacaccaaaaaccccactttccttaaaaataatttacaacgaacaaatcaccatccctaacatttcaaattttacaattcacaattcacaatacgaaaaaataaactaaatcacactacaacaaactcccctccacgtctaacaaaaaaaacgaaaaattttcttaaaaaactcgaccaatatcaaacaacaaaaaataaaaactatctcgataaaaaaaaaaacccaaacttccgaaaacataaactaaaaaatataaaaacaaaacacctactaaatctcgttaaaattaaaacttcaaaaaaaattaaacctactctaaaaaacaatataaaaatcccaaccccgacctaaaaacgacacgttcactaccaaaaactcaaaaaaaaaacaaaaaacgaaaaataaacgcgaaaaataaatacgaaaaaaaaaccgaataaaaccccaaccccgatcactcaccacgaacgaaataaaacaaataaacaccaccaaaaaaataacaataaataaaataaccatctaaatctcgacgcccgcgatacgacgaaaactccgacgacgccgaaaatcgctaaaacgcgacaaaactaaaaaaacaacgaaataaccccgaaaaacaaccgaaacgaccgcgaccgcgtaatactactcgatacccaacgaaatacgacgcataaactaacgatacatacgaaacaacgcgccgcacacaaacacgttacaaaaaacgataacgaaaataaaaaaaaaactaaaacccgcgtacatataaaaataaacgacgtacgccgtcacgttaataatccaatcgataaaacaccaaatatctaaatactacaaccgcgaactaccgaaacccatattaaacaacgcgcaaaaaaaca

SEQ ID NO: 79 - DNA, 1066 bp, Artificial Sequence
  bisulfite converted genomic DNA
tactcttttacgcgctacccaacataaatctcgataactcgcgactacaatacccaaacacctaatacttcatcgactaaaccaccaacgtaacgacgcacgccgcctactcctacatatacgcgaacttcaactccttcctcattctcgccaccgtcctctacaacgtacttatatacgacgcgctactccgcatacaccgccaattcatacgccgcacctcgctaaacaccgaacaacaccacgcgaccgcgaccgcctcgattacctcccgaaaccaccccgctacctccccaaccttaccgcgcctcaacgactttcgacgccgccgaaacttccgccgcatcgcgaacgccgaaatccaaataatcatcttactcattaccacctccctaataatactcatctactccatcccgctcgtaataaataaccgaaactaaaaccctactcgacctttttctcgcatccacctcccgcgtccattccccgctccctactttccctctaaatccttaacaataaacgtatcgcctttaaatcgaaactaaaattcccacactatttctcaaaacaaacccaaccctctttaaaatcccaaccctaacgaaatttaacaaatactttacccctacatcccccaatttatattcccgaaaacctaaatttctttctccaccgaaacaacccttaccccttactacctaacactaaccgaatcttccaaaaaaaccccccgccccctctattaaacgtaaaaaaaaacctactataatataacttaacccattcctccgtactataaactataaactacaaaacctaaaatatcaaaaataataatctattcgttataaaccatttttaaaaaaaataaaatttttaatattttaatatatacaaaatttcttaaatttcttcccccgtaaattacgtaaaattttaaaactaaaaaaaatatcaaaaaatattttaatctaactccctcacttcactaaaaaaataaataatacgcttaaaataatccaaccgaacctacacaatcaaactaaactccctactcttt

SEQ ID NO: 80 - DNA, 1066 bp, Artificial Sequence
  bisulfite converted genomic DNA
aaagagtagggagtttagtttgattgtgtaggttcggttggattattttaagcgtattatttatttttttagtgaagtgagggagttagattaaaatattttttgatattttttttagttttaaaattttacgtaatttacgggggaagaaatttaagaaattttgtatatattaaaatattaaaaattttattttttttaaaaatggtttataacgaatagattattatttttgatattttaggttttgtagtttatagtttatagtacggaggaatgggttaagttatattatagtaggtttttttttacgtttaatagagggggcggggggtttttttggaagattcggttagtgttaggtagtaaggggtaagggttgtttcggtggagaaagaaatttaggttttcgggaatataaattgggggatgtaggggtaaagtatttgttaaatttcgttagggttgggattttaaagagggttgggtttgttttgagaaatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagta

SEQ ID NO: 81 - DNA, 1021 bp, Homo sapiens
gccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtt

SEQ ID NO: 82 - DNA, 1021 bp, Artificial Sequence
  bisulfite converted genomic DNA
gttagttattattatgtttattttcggggttaattcgttcgtttttttgagtttcgatcggttgaatagtttagtgattatttcggcggtgatgtttattttcggggtggtgggtaatttggtggttatcgtggtgttgtgtaagtcgcgtaaggagtagaaggagacgattttttatacgttggtatgtgggttggttgttatcgatttgttgggtattttgttggtgagttcggtgattatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgtt

SEQ ID NO: 83 - DNA, 1021 bp, Artificial Sequence
  bisulfite converted genomic DNA
aacaatataaaaatcccaaccccgacctaaaaacgacacgttcactaccaaaaactcaaaaaaaaaacaaaaaacgaaaaataaacgcgaaaaataaatacgaaaaaaaaaccgaataaaaccccaaccccgatcactcaccacgaacgaaataaaacaaataaacaccaccaaaaaaataacaataaataaaataaccatctaaatctcgacgcccgcgatacgacgaaaactccgacgacgccgaaaatcgctaaaacgcgacaaaactaaaaaaacaacgaaataaccccgaaaaacaaccgaaacgaccgcgaccgcgtaatactactcgatacccaacgaaatacgacgcataaactaacgatacatacgaaacaacgcgccgcacacaaacacgttacaaaaaacgataacgaaaataaaaaaaaaactaaaacccgcgtacatataaaaataaacgacgtacgccgtcacgttaataatccaatcgataaaacaccaaatatctaaatactacaaccgcgaactaccgaaacccatattaaacaacgcgcaaaaaaacacgttaaacgcataaactacaaaaaacgtaaaacccgccaatcgcttatccacgtaataactataaaaataaacataattaataaccaaataacgctcgacactcataacgcaaataatactaaaaccgaacaaactaaaaaaaaacaaaataaaaatactatactcgcacaacgactaacccccgaaccattaacccttcatatacgtaacgataatcaccgaactcaccaacaaaatacccaacaaatcgataacaaccaacccacataccaacgtataaaaaatcgtctccttctactccttacgcgacttacacaacaccacgataaccaccaaattacccaccaccccgaaaataaacatcaccgccgaaataatcactaaactattcaaccgatcgaaactcaaaaaaacgaacgaattaaccccgaaaataaacataataataactaac

SEQ ID NO: 84 - DNA, 1021 bp, Artificial Sequence
  bisulfite converted genomic DNA
accaaccactatcatatccactcccgaaatcaattcgtccgcctccttaaaccccgaccgactaaacaacccaataaccatcccgacgataatattcatcttcgaaataataaacaacctaataaccatcgtaatactatacaaatcgcgcaaaaaacaaaaaaaaacgaccttctacacgctaatatataaactaactatcaccgacctattaaacactttattaataaacccgataaccatcgccacgtacataaaaaaccaataacccgaaaaccaaccgctatacgaatacaacaccttcattctactcttcttcaacctatccgacctcaacatcatctacgccataaatatcgaacgctacctaaccatcaaccatacctatttctacaaccactacgtaaacaaacgattaacgaacctcacgctctttacaatctatacgtccaacgtactcttttacgcgctacccaacataaatctcgataactcgcgactacaatacccaaacacctaatacttcatcgactaaaccaccaacgtaacgacgcacgccgcctactcctacatatacgcgaacttcaactccttcctcattctcgccaccgtcctctacaacgtacttatatacgacgcgctactccgcatacaccgccaattcatacgccgcacctcgctaaacaccgaacaacaccacgcgaccgcgaccgcctcgattacctcccgaaaccaccccgctacctccccaaccttaccgcgcctcaacgactttcgacgccgccgaaacttccgccgcatcgcgaacgccgaaatccaaataatcatcttactcattaccacctccctaataatactcatctactccatcccgctcgtaataaataaccgaaactaaaaccctactcgacctttttctcgcatccacctcccgcgtccattccccgctccctactttccctctaaatccttaacaataaacgtatcgcctttaaatcgaaactaaaattcccacactatt

SEQ ID NO: 85 - DNA, 1021 bp, Artificial Sequence
  bisulfite converted genomic DNA
aatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatggttatcgggtttattaataaagtgtttaataggtcggtgatagttagtttatatattagcgtgtagaaggtcgtttttttttgttttttgcgcgatttgtatagtattacgatggttattaggttgtttattatttcgaagatgaatattatcgtcgggatggttattgggttgtttagtcggtcggggtttaaggaggcggacgaattgatttcgggagtggatatgatagtggttggt

SEQ ID NO: 86 - DNA, 96 bp, Homo sapiens
ctgcctccccagccttgccgcgcctcagcgactttcggcgccgccggagcttccgccgcatcgcgggcgccgagatccagatggtcatcttactca

SEQ ID NO: 87 - DNA, 96 bp, Artificial Sequence
  bisulfite converted genomic DNA
ttgtttttttagttttgtcgcgttttagcgattttcggcgtcgtcggagttttcgtcgtatcgcgggcgtcgagatttagatggttattttattta

SEQ ID NO: 88 - DNA, 96 bp, Artificial Sequence
  bisulfite converted genomic DNA
taaataaaataaccatctaaatctcgacgcccgcgatacgacgaaaactccgacgacgccgaaaatcgctaaaacgcgacaaaactaaaaaaacaa

SEQ ID NO: 89 - DNA, 96 bp, Artificial Sequence
  bisulfite converted genomic DNA
ctacctccccaaccttaccgcgcctcaacgactttcgacgccgccgaaacttccgccgcatcgcgaacgccgaaatccaaataatcatcttactca

SEQ ID NO: 90 - DNA, 96 bp, Artificial Sequence
  bisulfite converted genomic DNA
tgagtaagatgattatttggatttcggcgttcgcgatgcggcggaagtttcggcggcgtcgaaagtcgttgaggcgcggtaaggttggggaggtag

SEQ ID NO: 91 - DNA, 83 bp, Homo sapiens
gccagccactatcatgtccactcccggggtcaattcgtccgcctccttgagccccgaccggctgaacagcccagtgaccatcc

SEQ ID NO: 92 - DNA, 83 bp, Artificial Sequence
  bisulfite converted genomic DNA
gttagttattattatgtttattttcggggttaattcgttcgtttttttgagtttcgatcggttgaatagtttagtgattattt

SEQ ID NO: 93 - DNA, 83 bp, Artificial Sequence
  bisulfite converted genomic DNA
aaataatcactaaactattcaaccgatcgaaactcaaaaaaacgaacgaattaaccccgaaaataaacataataataactaac

SEQ ID NO: 94 - DNA, 83 bp, Artificial Sequence
  bisulfite converted genomic DNA
accaaccactatcatatccactcccgaaatcaattcgtccgcctccttaaaccccgaccgactaaacaacccaataaccatcc

SEQ ID NO: 95 - DNA, 83 bp, Artificial Sequence
  bisulfite converted genomic DNA
ggatggttattgggttgtttagtcggtcggggtttaaggaggcggacgaattgatttcgggagtggatatgatagtggttggt

SEQ ID NO: 96 - DNA, 66 bp, Homo sapiens
tttccctctgagtccttggcagtgaacgtgtcgcctttaggtcggggctgggattcccacactgtt

SEQ ID NO: 97 - DNA, 66 bp, Artificial Sequence
  bisulfite converted genomic DNA
tttttttttgagtttttggtagtgaacgtgtcgtttttaggtcggggttgggatttttatattgtt

SEQ ID NO: 98 - DNA, 66 bp, Artificial Sequence
  bisulfite converted genomic DNA
aacaatataaaaatcccaaccccgacctaaaaacgacacgttcactaccaaaaactcaaaaaaaaa

SEQ ID NO: 99 - DNA, 66 bp, Artificial Sequence
  bisulfite converted genomic DNA
tttccctctaaatccttaacaataaacgtatcgcctttaaatcgaaactaaaattcccacactatt

SEQ ID NO: 100 - DNA, 66 bp, Artificial Sequence
  bisulfite converted genomic DNA
aatagtgtgggaattttagtttcgatttaaaggcgatacgtttattgttaaggatttagagggaaa

SEQ ID NO: 101 - DNA, 20550 bp, Homo sapiens
cagtgcacacaatataaacacacattatcaatacttacaataagagattggaattaaagtgcacaccacctcccaaagtttttcaaaactgcttctaatcacaaaaaggtaaattaaaaatcctctctatgttacagtagtttaaaaggtaaataatggaagtagaaaggagatgtacatttgttgaaacctgttatgtaccaggcaccttacataacttatttttatttgatcctcacaataattggcaaggtgtgtgctgcaggacactaagaggtcatagattttaggaggctaagaaatgacctaaaactttacatctaatagttggtatagcaaagatttgaagtcaagaatatctgcctctaaaaattagccgtatactatgacaacacatcccaaataaagatgtataaaaagtacttggctcttcatagatattatataaaatatgggacaatattagtgatatacctaaatttagacattagaaagaagtccttcttaatttactctgtaattgtaactcagttgttcatcttacaggtccctatagtaataattaaacattcctttctttgttttatatgtgttttcaaactgctattaaagatccttggtcagcagcctttatatcttttggcgttttgctgctaatgctcggtaaacatgggcagccaaggaaaatgcagatggtgctatggaacacaaaccacgacaacatatggtatacatttagtcctaacaaagtgcgcttcttaacctctgggtgtcgcttcaccattcctttataagactactcatttccagggaaggtttagtttccaaaaccagggcaacaggcccacatgtgttatatggccattcagatgcacagattatgtgtcctaatacctttaagcaagtgcatttagcacatgcttcctagcactatcatgtgtatttatgaactgttttgcccagatggtaagctcctcgaggacaagtgccatgcctgaaatctcaccttattaactgtgcatggcagagtaacaatgttatctatcttgcatatagagacacacaacctataaattgctcttctaggtaaacctcctaactacactgctacattgtgacaattgtcacatcttctagatgaggctcacacaggctaagcaattagccagaatcacaaactaacaggcaatgttttcttcttgcccacaagagaaagcttttcttgtcttgcaacactttattgtttttttcttttaaggtttttattacaaaggtcaatgtctattggccttttaataaaagtaattattatttagtacttagtatacatatgcaaggcattgttctaagggttttacaaatattaactcatttaatcctcctaaccattccatgagatagacactatttttatccacattttacagataaggaaactgagggacagagagattaacttgtccaaaatcagaggactggtaaacagtagcagtgaaatttgaatccagcagtgaagcatagctccacagtgtgtgctcttaaacatacactattctgcttgaataagagtctacaaagatccttactcaggacatatgaggagttgttcagcaagaaaagaagcatgtttactcctccctatttgatgtatttgattatattctaaaacctttcctcatgccaatagaactccgcgtattatactaaactttcctgcaccgaaggcatatgtaatggttaccttgactgacatgtaaaatacccaaaacaaaataccccgagactcgaggattttttgtttcatgaattagacaccaaaaaaaaaattgtctaggcatcagaagtgttatacactcacatctgtaagtctttcttgggattttcagatttcttatacaagatttttttttgtctgaaatatttcagtgctcactcaatgcctgagcttgaaaattatctaatcctttttaattttttcattttcagctactttgccttcaggcatagggcagggcaagcacttgctttcaatatgatgtttaacactttttatgtttttattttcgtcatcttgaaaacatgctagtaaacatccaaacatactgtaaagatttaaaatttggggtgtgtatacgtatatcaacaggagttatgaattatgtatattgcaggcctatataaattagattttgaagaacaagcatcacagtaatcaagcgggtcataataagacattccatgtgaaatgtaaaaactaccttgaataaattatctgtaagttaacattctcattagaatgacatatttattatttctgggtttgtgatattgctttaatgtattttggctaactgttttaatggcatattaagaaaccatttcaggccttttttccccgttggaatttgcagacttttatttccgtttgaactaaaataatataatattaaaaacaatcccccacttcccaatgtacaataccattttcttctgcccagaaatatttaattaaagcaggatataacctcagtaattatttttacacagaatgactcttaaattaatagtcagttgtatgactaaaaattgggagactgacaatcaaaacaatcttaaatgctttgtttatgtgatgaaaatgagtgatcctttaattccctcacacacattaaactgatttcacagattttctgtactggtgtttaacatagtcaagtgcttgaggttatgtaaaataaacaatcttgagatcttattgcaaatgtttgcaatttatgatgtaaactgatttgtgaagaaaaaacaggatcctatgtcgctgaagccaaagaggcatttttcagaaatcaaaatagttccgaaatttgagcattgcattatactaaagtattaccatctgaggacccaaaaaagttataaatctggggaaaaactcaaaatagatgtacatcagttcagctccaagcaaaggcaccgatcttactatcttactgtgtctcttgtatcatagggtccttaacactaatgatgtcttaaacaatctcttttaactcagtttttcccagtcattgattttgcaactcgggaaggttttgcatgcccaaaagatttggggagcagaggatgggggtgtcctttattaattatattaggattattgagtttcgacccaaactacaagcatgttgggccttatttaaatttaaagtgaattcctcagaccccttcttgggatggttcggggaactacgagtttggaactcttgttcacacaccgaggcgcctgccccagagtttggacactggcattccgggagagcaggccttgcgggagtctggacccgaagggcgagactccacagggccaaggaaagcggcctctgtcctccgttagtcttgggggagcagacgcaagaggaggcaagggcgccgcgagctccccggatgcactggtcccacaggccgtgcccgagtggagcactgcgaatggggccaagaaattttggcctttctcgccggacctggctgcctccgcgggcctctccgcctaccgcgctcccgccgcggcccgactcccgcgggtctccgcgccgaacccacctggctcctatcgcacgggacattcccgacccacccacgccgcgtcactgagcctctgtaccgatacccggcgcctccgccagcagggcctggacgcaccgcctcctttgacctcgggcttcccccgcgctccgctgcttggggcagactggccccgagagggagccaccatctcccctgctccagggtctccagggtccgaacccgtgttgggatctgggttaggattagggtttggagcttggagcctgcctgttaggacccccggccccggcgccgactggagctcgctggaggccacaggaccacggcggatggcctggctgcttcagggcgtaccatgcccgcaggcagatgtttattattaaaaactaccgacgttcatcaaccaggagacccgcaaggcctgcgcactgaatacggcccaaatcctgttcagtggtctttgaaagttaaaagaaagaaacctatcgcccacgtctatgctgaggaacagctttgaatacgagctaagacctgggagagggccaagtgggggtggtggggaacactgctggaggatgtggggctttggcaggggttttacgcaccctccagcacgagggtggggggtcccaggggacgctcaggactctttcagtctttgcggaaggtcccgtcatcacaagagcccgcgcgggaaggaaagttcctgccttggacatggtcagggccgagtcttcaaagtctccaactatccccacacaggcagcacctttgggctttactagtgggatttcttccagaagggggccacgacatggggagagagagctcctcattattttcaaggccaggcttttcctaaacccgattctggcttccaccttctaaatttaaccaatgaagaagctgcttcagccaaccctaaacaggagtgtcagatggggaatcctccctccacagtgccctggcctgcccgcctttgcggctcttttcccgctccgaagtcagcacctgccccgctccagagagggtcaacgaactgggactgattgtcgattatgccataccaaacccaggttgatttcgctccgcaggatccctccttccttcctcccaaaagtgtccccagataaagactggaattatagcaaaacgaataacgagagtccatcttggggaaggaagttactctatcctatgttattttacttcttatctgttctttcattaatttggtataaccctgtttctatgctgggtggataaaatggagggggccggcggaaatgcgctcagcgctaacgacagccacagagccacccttcttactgccccttgactgcggcacgtaagagcagaggcaagcgcttttccaagttggtatattcgagagagtgatacgcattaatcaaaagggaaagactatcccggatattttaatagtaacaggaacaaagatgactcgaaccccatcaaatgaaacgatattttcattcaattgatcgcaaagtgtcttcaattaataacttggcacttatttaaaaggtttaacagaattggaggcgacacattttgtactgacaacacgtcatgagataacatcttttgtttaaaataacttaatacactagaaaaaaatatgtcaaatataaataattttgttttcatggagaacaaatagttacaaagctcaaccgcataccaaagttcagttagaagagcttttcctctttcttgtaaattagaaggtaaaacaaaaacaaaaacaaaaccccacaaacttaggcttgctagcgaattgggatacagactggcttagtccaaggtatcccagtttaaatagctacatgaattgaaacaaacaaccaaaagaaaaaaaaaaacaaaaaagaaacaaacaaacaaaaaaaaaaggttacttgaatagatacacctttgtgagataaaatgcaaatgttgaaagtcagtccacacattatagtcaaaataaactttgttcgtgtgtatcaacatatcttacacaaacctagtgcctgtatctagctgggtgttatttaaggtgaatttgacgggatagagagggggaaataaaccactgtcttcaaataggacttcaggaaaccaacaagaaggaacacaagaaaaggggaatggtgggaactaatactgattgagcgcctactgtgtctggcacagcgaggcgctgtaccttcattatttcatttggtggtcttgttttctttttcctttccccacatattctgcccacctctgtcttcttaggacaatgagtgtaattttttccctttctgacttttttcttttgttccccaggatcaaagacagggcaaatatatatatatatatatatatatatatatatatatatatatggcaaatatatgatatatatatatggatatatatatatcaatttccagatacttttggtattgtttttcatagtgaagatgaaaatggagtgagtgcatgggagataagggggtgggaggagacacaccatcaatggaatacaagtaacatgcaaaccggaatttactgtcagcagtccagacagttttgccataataatttctcagagaaatcattgtctgtggcatttttttgtgttaatattatttttctctctcctcgttttaatattttctcttttcttgctcttccatacatggtgggtttaaactcaaagcatctgattcaacgtaaaaggaggcccgcctctctcatcaaatttctcgtgttaacgtgaacttcgcagaaaaaggtcagtttcaaaacctgtgaacttcccagctgcgcacttttttcatcttagttttttaaataagtatacctcttctttctgctttgccttcttagcgcatttttaaaaacacacatttaagttggtaactccccccagtctctcgagaatcgtctgggttgtttttccatatttttaaatgtataaaatactttaattttaaaatttgtttttgctccttggttctccaatttcagcttctgccaaatagcagttaagaaataagttcccttcctctttttctctcccgtttgtctttcgatttttttgtttgctcattttttcattgttaacaagatttttttttctatgcaagagtccatcgttgcagctttgcggtgagccaaactccgcggttccagcactcccctgtccagtctctctccagactcccccaaacccgctcctacaaaacccaattctaggccctcgagtaggaaaacgggcaggagccacggagcctgcgtgcctcgtgagatccctggtcctgcgtggagtctggctttccgagtccaagatgcgataggggacgagggatggtcagtgaggcgggaagagggccggctcccgaggtctcaaaggggtaacggagaagcagcggggcgcggagggcgtgcaggctgagtgccgcgggacaggcgcgacattggtgctggcgttggcgtcacagacccagggctgcggcgtgctttttggctttcagtctgagatcggcgatgctggagttcttgctggtggtcttggcggctgctgcggccgccactaccgaggcggcggaagccgaatccgcggccagcgtggcgagcggcagtccgaagggcggtgctgggaacatcatgtagggcgcgtgcgcggccaggtgcggatgcaggtggtggtgcgcgtgcgccacagcgctgtccagctgcagctgcgcctgaacctgaaaggacaagggcgtcacgttgcaatgactatcctagggtgacaacagaatagaaacagagcattaacggcgtccagcttggccagagagagagttgggttgtgtttgggcacggggagagggcatttggctgtgcatcttgttccgacagtgaccttctcagcctgttgctgaatctggggttccacatggatactccagtgtcccctgggtctccgaaactcgcttagggtaggcttatttccccggaccccgggaacccccttctgcaggaatgtggccgtctcccctgggaactgggctgaaatggtatattggaaagactgcgggtgaggacccttaccctcttctcttgatgctgccatgcatctcttaccccactaccaaaacaacggagtatcaacaagcaaactacgcaactttttaatgtcattcagggaagttactccatcttcaccacaataggcacaattgtgagtcggtacttctaacctttattgccataacaattacccagggatctcgttaaaattcagattctgattcgcaaggtctaggttggggcctgagattctgaatttctaacaatctcccagacggtgttgttgctgctggcccaaagattaccttttgagtagtaaaggtctccttttaaagtcacccctccctctttcttcagtcattctctcttgtttccaaagccaagcatcaggatgccagagtcctgtggcaccaagagagctaagatctccctaacaccgactctcaattcatggtcacacctatctgtctccccggtccaagtcactggagactgagagctaattcatgacatcacaggcatgccaagcaggggtcctggctgaggatagggaaggtcagacactggttgggaaaggatttcgccctcaggcttggaaagtggggagttcagagcactgggatttcccaggattaaatcattgctgcaggctgtccttttaaaatgtactcttaaaggtttctttatggctaagggattgcaaaggcagggcagccctgggaagaccaagacttctctctttaccagagatgaagctttgtttgcagaaacagatttaaaaacaaaagaacgaaaaaacaaaagtatgagctgggagtacttgtgtttatttttcttctgtcagagttatttaatgtgactaagaggtagaaaatacctagaaaagtatctagagggttgccttagaaataccttaggactaacctctgtattggatttgacaaaatcttaatcaaaaggcttttccttcctctctctctaagggcaatctttagtgtatttttaaaggaccagttactgcccccaggccccttcagggattcccatgaggacagaagggactaggcattcaggcctttaataccgtataggtttttaaagggtagtgggtccactatatcatctcaaaatgattctccaactatgcagacattgacatctgggctcagagacaggtgatgttcaacagttcaagcaaacattcaggtattttcatatttaaaaacagcttgaaactaggctgtacttgcctgctgaaatggcatccttaaagcacctacgttgacataaggtgcgactctacaagcttcaaactggctggcggcccctatgagaacacctgtaaaaagtacaagagaaaaataatgtgaggttaacgtttgtagcatttttcagggttccaaagggtacaagacagaacgaattcctttgaaaatggactattatctttctaaactgcatccaaaatttaaataaatgtaacttactcccaaactttaggactccattaacagcctttgaagattattaagtcaagaactattgtcatttttgaggttcctttttttctgtcattgtaatagtaatattcactacttctctctttgctcagactatcaaatgttccttgtataagaagcatacctttatggagttgattttcttgttttctacatttagctcttcgattttgaaaccaaacctataggttggagggggaaaaaaaataaaacctagatgttatgactaaaaatttttttaaattacaaaagtacaaagagaaaagagtcgtggtttagacaagaattgggagatacagcaagcaatctttgaattgtataaaacagcctcaaattccaaagttaaacatgtaaattaactacagaaatagaaagatagattttatagactttcacaagatagattactattagtcctgatttcatcttttcacataacagagtccccatggcctaaaactctgcttggtacctgataccaacatgataatggtttagatatttgcccagttaagacctgagaagaatgtgttcattaatagcctgtaatgttaattagcttcatcttaaagaaaaaccaaacaccagagcaaataatgactcctttgcggagaaggagttgtaagggttggggagaggtaattagtgtcataaaagcctcactacaaagaagtttagaatttctctgttctgctgtgcagcagagtgaaacacagtagcagaataattgtgcaccattatcatgataatctaatttgcttctttagaaaaagccactgtttgcagttaggatagtaggaaaacatctagaaaataactaaaatgtaaataaaagtatgaaacaacaataaagttcacttcttaagagaaaaaaagaagagcactcagcgaaaggagaatgaagtatatataaagcaagtaactcttaggtactttgttctcctggatgttacctgcttaaacttgacaacttttacaggcagtatgacagattttttaaaattcaaataaagcttgcttttgtattccactttcaataataaagcatattgattgactcacaaattaaagtttttaaaaccccattaaagtaaaaatactgcttcagagctttcattggtatgtttttgaaagcaagtgtcatagtcaatgtaaatcttcaaaaatttctctgctatttagtacaacagagggtggattttgtgccagggtggcatcctttgtgtaattcacatggcctgaggcttcttgcctttttttcccctagaagagttggaattaagatactaataatcataactgtaataattatcatcatgtttttaaggggttgctgagcctctggagatctcagtgcacagagcgaagcaggagaggcttaaaaaggaaggctctgctgctgatgctgtgatgaccaaggcagcctattattacttttcctcttcaacgtgactgctctgtttttttttttcctgatcctgttacaagatgtggggaagccccttaagaattgtgcatagttcgctacagatggtggtctctgtgcccagagaccgaaagagtatctgttacagcgatactttgtaacagctgcagatgtgcgggcctaaaactgctccatgtgttcaaaccaataataactatcattttattctattttattatctgagcggaaatacaatctgaaacatttaaatttgttccccctaaagctagaaggatatgtgtatgtgaatgtacacaatttgctcctttaaatgcccccaaagcctatttttgctattacatttgcctccacaaccaataaagaaaatctgtttcagtcctaacttcattgggtatggcacgtgctggagggcaggctttggaaatataaatactaatatatgtggtttgttttaaaatctaatgtatttagggtcagtttcgttgccttggttaaatgaatgaacaaagagtgaccaaaatgcgtttatttctccgctatttcacacacagtttgagatcgaccgctaacagcagactgtaaatttctgcacttaacagttactaattttctttatagtctgcacatctataaacctaattgggatatccgcttgacaaacctagaccctgcagagcagactttcaaggaaatccaactccagagaacaaaatactctttggaacttttaaggcatccagagataaaacgttttctgtgggatttttttttaagccttataaaagtaggcccattaggattaaaccacattaaagccagtgcgaggcaaggggggtgtggtttatagaaactctgggagaaagcccagcacagctttcttcttctgggaacatatgttaggatggaaaaaaaaaaaaggaggggagtgctataggactaagatctactttggaaaataagacctctagtaaagatatctctttccttctcatcttacaccagacactagaagcaccacctcccgagtgtgtcccccaagcctctttccaaccccaggctctctctgctccctgggccctcgacctcctggcagctgggtacctgcactcgggcctccgacaggcccagtcgctggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaagcgcaaaggtcaagtctgagcggccgcctggggcaaggtgggcagtcatccaccacctccttcacaaacgtacctcgactcaccgcctcactattcaccccccagtcaccggccttccccagcaaacaccaaatggtttccactcactttcgcactcacttgctccgcagcactcacagaaatcaaaggcgcagcgccaggcctctcacagagcaaagtctggacataagggcgcggcaaggccacccactggcctctcacaccggccattcccagaaggctggctcgttctcaggccagctctcaccaccgctggctctctgcctaccgcaaacttgctggtctaatttaggaacaattgggccgaaaggtatcagcgagagcaacagaccccggtgttgtgccgcacagggagccgcatccgcagacgcccctcgctgcccctgggctcgggccaaaccctgcataaggtcccctggacagccaggtaatctccgtcccgcctgcccgaccggggtcgcacgagcacaggcgcccacgccatgttggctgcccaaagggctcgccgcccaagccgggccagaaggcaggaggcggaaaaccagcctccggtggcgggcgaaagcaaccgctctttctgttctctcttcgccctccctcgtggaaacgcagactcgaccctaaacgcttaacccacagagatcaacaggttcaagcggaatattcgcgatcctcggtttctattggttgctcaaagccttttcatgcaaccagcagctcggatgtttaataaaatatgaatttttctgctctgggtttgcacacatccgttgccactttcctgtccttctcctccctttaaaaacaggagctcttctagtgtgagcatatacagccaccatatatatatccccctggaacctttatcctctgcgcccgaatcagagactccgggttttaagaagtcaaagctgagtttagatagtcgaggctgtttgcagttcttcccagcgcaggatccaggccagcatgggtgttaaaaatcatttccggaagagccggtctgcagagaaattaatacttgccctgagcttggaaatcaacaatcccaggaactgcgcccgccgggggttcagacctgaacctcgccgtcaggcgcgctggcgaacctgtagttcgggcctgtagttgtggactcatggccgggaggctgcactgggcaccttgacggtaactccaccactttacaaatttaggaagacctggtgctggtttggaggaagaagagtcgctagatctcggccctgccgggcattctagctacggtgatcttaaatattgccgtattttctagttctcagagttagttttgtggacatttgtcctttctttaggaaggaacattatagtaaacattatgggccaatttaatagcaaagtatttttactgatattgtattgaaatttaaatatgaaaacacacccttcaaattctgccaatgaggtgggaaggctttgtctattacatgtcatctacacagtggatgccactcaaagttttggggcttcgaggagatgtccaaatttcaagttgatccatagacttaataaaatctctatttttgtccccaaatttccaattactgatctaaacaggaacagaccgtgtcataaacaacttaattgcttgcttaaatatgtgattccacgcatgccacatattttcttaattggaaaaatatggcagtacaccagttactgcaggcaccaagtgccaaatcaattttattgttgaactcctttgaattggtatagaacgctctgccattgagataaagacgtttcctaacactgagctagcaccaaaggatttttgctctaagagaaccgagtactgggtgattgaaaacactaaaggaattgtgtaaatatagatccccacctcccccgccgccccccccccccgcccccaacacaccaagaaaccgaaacgcctcgcccgggagaagcagcgtagcctggacctcagctttcgttggcttccttctaccttgaaagagaatgggaagttttggcccctaagatccaaagattcaggggctctgcggagttcgaggggtcttggcggccccaaacacctaggcgaccggagggttaagctttccacctctgccccttctccctcccggcaaactctgcgctagaggctagctttagtcccgccgtctggttcagcaccccctcctgcagcccggccccgcgaacttccacgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgttaccctccgtcagtcgcgggctgcccggctccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttccttcttctttttttactgctccagcccccccaataataacacatcaatgggacaggaggtgggggaggagagggaggaggagaaagaagaagaaaaagaggagaagaaagaagaaagaggaggagaagtagaaggagaaaaagaagtaagaagaggaggaggaggaagaagaggaagagggggagaagggtgaagaggagagggaggaggaggaggagaagagaaggggcgggggctgccggagggaaatgggaactgatgcttccctgccggagcgcgcttgttcaatgttaagatctttgacaattcttcctgcggagagttcagatctgatagcgacgctgcgcttgaagtcccactatttatacttcctaacggcggcctcttgttttgagtaaattacctcccctcgcaactcggagtgagcccccttcccgggtagcagtcgcgcctctaccgggggttggggaggggaaaaggagagaaacagagagagagagagagagagagagagagagagagagagagagagagagaagaggagagagagagattggagttcgggcgggctggggctggagtggtagggcagcacagggggaccggagggggcggggagagaaggccggtccccggccgctcaggttttcagatagcccctgccgcctgtgctcttggccattaatccaggattgacaagaatccctaattaatttaattaggcgtggattttgcgttggtgtcacgacttagttaaacactggggagctggatagaccccgcggggtggggccaagaggaaactgacaagtgcgcagctcttagagtcagtcaggtatcccgacactgcatccttccctacagccttgcttcgagtcagggtgcctcgcaatgctcagcttcgcattgcttttcctcgtccctgccctgcatcaaccgcccagcagtttacaggccccgcatcccattcccgcatcctgaccccgcatcccaattctgcatccccgcctctccctcacaatcccacccctgccggccgtagctccaccgcccagcatcatcctgcccagagacagggttgcctgcaccttctccgacccgcgcagcttctcttaggagcttcccggctcgcaggcaggctgagtccgggtcttctccaagctcctcgcccctcggtccgtgttattcgctctattattcgtgtcctggagcccagctgactcctctatggacagaccccgctaaaagggaccagtcgatttaacaagtttccccagcagctgttagctgacagatctcattttaaagtgtttccttagcgcccggtcaaggacagctcgacttcgttcgtttcctctctgaggtctcagaactcccacccttctcccttactctctgcactcggacccctctatggtgaattacaggacttcttctttagcatcttgggaaacatccgagtttatttactaatttgaaaaacaagagattatccctcttcgagtctgaaaaaaaaatcgacgttaagtttgtaccccctctaatttcatttattacggagagctaaaaaagagacgctcgccaggagtaaaggtctctctgcctaccccccccaccaccccgcttacgatttaaaattctatttctgggctattttcatcggaacggtttgttacgttagaggaacatctatattcctgagtcatttgtctgtattgtgccggacagggcttgctgtgagaagtgtggctatgcaaatacatactcacaaaagaatatttacatatgatgttatatttaagtgtgtaaacaaatatacctctaagtgtggcttaggggacattttcaagtactctgaatattaatgcagactttctggaagttaaaggtaacttgatcattattttggatctaatactcttagtaaaaataagaggaattacagaacattaatatgtatatcttccgtatattggttaaggcatcaaaacaaattagcagataatttaagaagttccgtcaaaacaacctgaaacacttgcaaaaagagaacacaattataacttaatatattagtgtttctcaaatagatgtagatagaagctggatataaccttatgttatactacaatactcacattaaaatgttcatgtttggtgagtttaaggattatgtatatcatgctttttagaaacgttgttttccctttttaaaacatttcattttttgccacttttaggagagctaatgtctataatttttccgcagctatagcttttaggtatgaatacattgttatcagtacttgcttttgttttgttacaccacaaaagggacaaagtttcaaagttatacgaatttagaaacaatttcacattgagtcttgggttactctttgtaactactttctgatattatcagaggaaaataatcatacaactttagtcctttatgaaaatctgtttttaagattatttagcagaagggccagtaatagggagagctaagaggatacggtgctcaaggtgctctcaaactgaggtgttaaatacatattcacaaataactcaaaaataaccactgttagaagtcggttaaggaatcaggagacccaccagctacttgtttgcctttttaagtacatgacttttaggtttgaagtcatatttcatctactgagcttgagggaaagatgaccactttgaaggtaatcagggaagtcacagacacaactattgtgtaattcaaaccaataaattttcccatgatctcagctttttggctcattgcatatttaggaatagtagtgttgataacagatggagccatgagaaatctttagtgtctgaccacagatttccactggcctaagggaagttactttaaaaaatatttcaaggttttaaattcatacattaataaatgctcacaaagttccaatgatgttgtttcattaaacagcaaatatcttccagaaacagggcatttcaaaatacagtttttgtttaaaaaaaaaaaaaagcatttatggtaaagctcagctgacagtctgtggacagatgcacaggttccaataaaattcaggaccccaagggtttccccagctcttgaattatttaaaatatacacgtagtgttgtagtagttaagttttaaaacggtgcctcaaaactggctagttaaggtacattatttacgaaaaatatattgtggaggtgatttttcaccatctcaaatgtctgcggaaaactgtagcttggttatctagcagtggtgaatgagttgattctcatagtcgaccaaaacccaggccaacaatttatttatctttttagctttgcttaagagtaaatgaggaaaaaatttccatgtaaggaaaaataagtaatgtagtatgaattacagaaaatgctgagtctctttaatttctattggtttaaataaaaaaactccacacacctataaatttgagttctctttcagaagaaaccgctccccgcctcgcctcaggcagctctctcctattcctctactaaccagttactttaatctgagaaactaatttgcactcaacttgtgagtgccttcaccttcagggcagaagaaacaccgacttttaatgcatttttgcaaataaatcattacaatttaatcacacacgactctatacagacacactcccatgatttattatcgttgggcgagtttccccctcccccagcgtgagataaccaattttgtttcgggtaggtgtcataaacaaaacttcctacgatgcagatttgtttactgattacccatgacgataacgacgactactaagacaataacactctccagtcccacctttattgcttttggtaacaataaaatcaaaataaacaggcacgcaaaacaaacgccaaacaaaaaatcggccgcgttacaatctactccctcggcattcccagcgcctggcagcgtccatcgatgcactcgatatctcggctgaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaaggtctggacccaggtgatgcccacgaccagggcctggggagcggcagccgtggctgcggagctccgaggccctgatccggcgagaggcgacgcggggcctggcgcagtttgcggctcagtgtctgtggagggtgggctgcggcctcggggcgtgcgcagtgtcaccgtgcgcatgcgtcccgcacctgggaggctccggactccttgggtcaaggctggtggctgtagggtgggtgggtggccgcaggcctcaagcttggccttctgtcttgaggacatgtcggagagttcgccgactcctcccctcgccccacgttcctggttcttcatagctgcttttgggtttcctggctcatcttgcaatataagcctggcgcttcctcactagctctaggtagggtggagcaagagggaggctggattctggtgccctctatcccatccactccactgtccctgccttagatccagctctctttctgattccgccctaccctttctggctcacactggcttgctgagagaagtggtgcagggtgaaatagatgttcctctcttgaaatataaatatgctcgccttaaacacactatatattcctttgacttctgtactggtggcatgtgaccaagagcatatggctctgtttacttttgcaagatgttacaatgcaccgtaaggcatgttgcctgctcttgattttaggttaaccttgacgtaatttctctctcagaggttgtgtatctttaaatgcacactggaaacctaaacaaaaaaatatttttttacactttcagaattagcagtaacccaattgtgttccagctaactaggtagtagataaataaattcaaatgtcttatgttgtcacaagaaagcattcgagttgtcatctttgaacttagatgtattataaaagttctaagtgaaggaggtaagcagagttcccaggtttaagatttggagcaggtgtgacagttgcaaccttgggggaaactaggtatcctttaagagcctctctagtcttagagtttataaatattcactttctttgcaggcaaagatttcatgctaagtgatataacactttatgtttttcaataagagggctaaaaatgtcagaatctgaaacgacaaaaacagctggcaccttctgttaattggccttgccaactcaaccagtctcacaaagaggggtgttatgaattggaaaagttctgaaagcgggttgtttatagtagatctatagttgtatttcctgctttcatgttcaaaccattggggataaattccta

SEQ ID NO: 102 - DNA, 20550 bp, Artificial Sequence
  bisulfite converted genomic DNA
tagtgtatataatataaatatatattattaatatttataataagagattggaattaaagtgtatattattttttaaagttttttaaaattgtttttaattataaaaaggtaaattaaaaattttttttatgttatagtagtttaaaaggtaaataatggaagtagaaaggagatgtatatttgttgaaatttgttatgtattaggtattttatataatttatttttatttgatttttataataattggtaaggtgtgtgttgtaggatattaagaggttatagattttaggaggttaagaaatgatttaaaattttatatttaatagttggtatagtaaagatttgaagttaagaatatttgtttttaaaaattagtcgtatattatgataatatattttaaataaagatgtataaaaagtatttggttttttatagatattatataaaatatgggataatattagtgatatatttaaatttagatattagaaagaagttttttttaatttattttgtaattgtaatttagttgtttattttataggtttttatagtaataattaaatatttttttttttgttttatatgtgtttttaaattgttattaaagatttttggttagtagtttttatattttttggcgttttgttgttaatgttcggtaaatatgggtagttaaggaaaatgtagatggtgttatggaatataaattacgataatatatggtatatatttagttttaataaagtgcgttttttaatttttgggtgtcgttttattatttttttataagattatttatttttagggaaggtttagtttttaaaattagggtaataggtttatatgtgttatatggttatttagatgtatagattatgtgttttaatatttttaagtaagtgtatttagtatatgttttttagtattattatgtgtatttatgaattgttttgtttagatggtaagtttttcgaggataagtgttatgtttgaaattttattttattaattgtgtatggtagagtaataatgttatttattttgtatatagagatatataatttataaattgtttttttaggtaaattttttaattatattgttatattgtgataattgttatattttttagatgaggtttatataggttaagtaattagttagaattataaattaataggtaatgttttttttttgtttataagagaaagttttttttgttttgtaatattttattgttttttttttttaaggtttttattataaaggttaatgtttattggttttttaataaaagtaattattatttagtatttagtatatatatgtaaggtattgttttaagggttttataaatattaatttatttaatttttttaattattttatgagatagatattatttttatttatattttatagataaggaaattgagggatagagagattaatttgtttaaaattagaggattggtaaatagtagtagtgaaatttgaatttagtagtgaagtatagttttatagtgtgtgtttttaaatatatattattttgtttgaataagagtttataaagatttttatttaggatatatgaggagttgtttagtaagaaaagaagtatgtttatttttttttatttgatgtatttgattatattttaaaatttttttttatgttaatagaatttcgcgtattatattaaatttttttgtatcgaaggtatatgtaatggttattttgattgatatgtaaaatatttaaaataaaatatttcgagattcgaggattttttgttttatgaattagatattaaaaaaaaaattgtttaggtattagaagtgttatatatttatatttgtaagttttttttgggatttttagattttttatataagatttttttttgtttgaaatattttagtgtttatttaatgtttgagtttgaaaattatttaattttttttaatttttttatttttagttattttgtttttaggtatagggtagggtaagtatttgtttttaatatgatgtttaatattttttatgtttttattttcgttattttgaaaatatgttagtaaatatttaaatatattgtaaagatttaaaatttggggtgtgtatacgtatattaataggagttatgaattatgtatattgtaggtttatataaattagattttgaagaataagtattatagtaattaagcgggttataataagatattttatgtgaaatgtaaaaattattttgaataaattatttgtaagttaatatttttattagaatgatatatttattatttttgggtttgtgatattgttttaatgtattttggttaattgttttaatggtatattaagaaattattttaggtttttttttttcgttggaatttgtagatttttattttcgtttgaattaaaataatataatattaaaaataattttttattttttaatgtataatattatttttttttgtttagaaatatttaattaaagtaggatataattttagtaattatttttatatagaatgatttttaaattaatagttagttgtatgattaaaaattgggagattgataattaaaataattttaaatgttttgtttatgtgatgaaaatgagtgattttttaatttttttatatatattaaattgattttatagattttttgtattggtgtttaatatagttaagtgtttgaggttatgtaaaataaataattttgagattttattgtaaatgtttgtaatttatgatgtaaattgatttgtgaagaaaaaataggattttatgtcgttgaagttaaagaggtattttttagaaattaaaatagtttcgaaatttgagtattgtattatattaaagtattattatttgaggatttaaaaaagttataaatttggggaaaaatttaaaatagatgtatattagtttagttttaagtaaaggtatcgattttattattttattgtgttttttgtattatagggtttttaatattaatgatgttttaaataattttttttaatttagttttttttagttattgattttgtaattcgggaaggttttgtatgtttaaaagatttggggagtagaggatgggggtgttttttattaattatattaggattattgagtttcgatttaaattataagtatgttgggttttatttaaatttaaagtgaattttttagatttttttttgggatggttcggggaattacgagtttggaatttttgtttatatatcgaggcgtttgttttagagtttggatattggtatttcgggagagtaggttttgcgggagtttggattcgaagggcgagattttatagggttaaggaaagcggtttttgtttttcgttagttttgggggagtagacgtaagaggaggtaagggcgtcgcgagtttttcggatgtattggttttataggtcgtgttcgagtggagtattgcgaatggggttaagaaattttggtttttttcgtcggatttggttgttttcgcgggttttttcgtttatcgcgttttcgtcgcggttcgattttcgcgggttttcgcgtcgaatttatttggtttttatcgtacgggatattttcgatttatttacgtcgcgttattgagtttttgtatcgatattcggcgttttcgttagtagggtttggacgtatcgttttttttgatttcgggtttttttcgcgtttcgttgtttggggtagattggtttcgagagggagttattattttttttgttttagggtttttagggttcgaattcgtgttgggatttgggttaggattagggtttggagtttggagtttgtttgttaggattttcggtttcggcgtcgattggagttcgttggaggttataggattacggcggatggtttggttgttttagggcgtattatgttcgtaggtagatgtttattattaaaaattatcgacgtttattaattaggagattcgtaaggtttgcgtattgaatacggtttaaattttgtttagtggtttttgaaagttaaaagaaagaaatttatcgtttacgtttatgttgaggaatagttttgaatacgagttaagatttgggagagggttaagtgggggtggtggggaatattgttggaggatgtggggttttggtaggggttttacgtattttttagtacgagggtggggggttttaggggacgtttaggatttttttagtttttgcggaaggtttcgttattataagagttcgcgcgggaaggaaagtttttgttttggatatggttagggtcgagtttttaaagtttttaattatttttatataggtagtatttttgggttttattagtgggattttttttagaagggggttacgatatggggagagagagttttttattatttttaaggttaggttttttttaaattcgattttggtttttattttttaaatttaattaatgaagaagttgttttagttaattttaaataggagtgttagatggggaattttttttttatagtgttttggtttgttcgtttttgcggtttttttttcgtttcgaagttagtatttgtttcgttttagagagggttaacgaattgggattgattgtcgattatgttatattaaatttaggttgatttcgtttcgtaggatttttttttttttttttttaaaagtgtttttagataaagattggaattatagtaaaacgaataacgagagtttattttggggaaggaagttattttattttatgttattttattttttatttgtttttttattaatttggtataattttgtttttatgttgggtggataaaatggagggggtcggcggaaatgcgtttagcgttaacgatagttatagagttattttttttattgttttttgattgcggtacgtaagagtagaggtaagcgtttttttaagttggtatattcgagagagtgatacgtattaattaaaagggaaagattatttcggatattttaatagtaataggaataaagatgattcgaattttattaaatgaaacgatatttttatttaattgatcgtaaagtgtttttaattaataatttggtatttatttaaaaggtttaatagaattggaggcgatatattttgtattgataatacgttatgagataatattttttgtttaaaataatttaatatattagaaaaaaatatgttaaatataaataattttgtttttatggagaataaatagttataaagtttaatcgtatattaaagtttagttagaagagtttttttttttttttgtaaattagaaggtaaaataaaaataaaaataaaattttataaatttaggtttgttagcgaattgggatatagattggtttagtttaaggtattttagtttaaatagttatatgaattgaaataaataattaaaagaaaaaaaaaaataaaaaagaaataaataaataaaaaaaaaaggttatttgaatagatatatttttgtgagataaaatgtaaatgttgaaagttagtttatatattatagttaaaataaattttgttcgtgtgtattaatatattttatataaatttagtgtttgtatttagttgggtgttatttaaggtgaatttgacgggatagagagggggaaataaattattgtttttaaataggattttaggaaattaataagaaggaatataagaaaaggggaatggtgggaattaatattgattgagcgtttattgtgtttggtatagcgaggcgttgtatttttattattttatttggtggttttgtttttttttttttttttttatatattttgtttatttttgtttttttaggataatgagtgtaattttttttttttttgattttttttttttgttttttaggattaaagatagggtaaatatatatatatatatatatatatatatatatatatatatatggtaaatatatgatatatatatatggatatatatatattaatttttagatatttttggtattgttttttatagtgaagatgaaaatggagtgagtgtatgggagataagggggtgggaggagatatattattaatggaatataagtaatatgtaaatcggaatttattgttagtagtttagatagttttgttataataattttttagagaaattattgtttgtggtatttttttgtgttaatattattttttttttttttcgttttaatattttttttttttttgtttttttatatatggtgggtttaaatttaaagtatttgatttaacgtaaaaggaggttcgttttttttattaaatttttcgtgttaacgtgaatttcgtagaaaaaggttagttttaaaatttgtgaattttttagttgcgtattttttttattttagttttttaaataagtatattttttttttttgttttgtttttttagcgtatttttaaaaatatatatttaagttggtaattttttttagtttttcgagaatcgtttgggttgtttttttatatttttaaatgtataaaatattttaattttaaaatttgtttttgttttttggttttttaattttagtttttgttaaatagtagttaagaaataagttttttttttttttttttttttcgtttgtttttcgatttttttgtttgtttatttttttattgttaataagatttttttttttatgtaagagtttatcgttgtagttttgcggtgagttaaatttcgcggttttagtatttttttgtttagtttttttttagatttttttaaattcgtttttataaaatttaattttaggttttcgagtaggaaaacgggtaggagttacggagtttgcgtgtttcgtgagatttttggttttgcgtggagtttggtttttcgagtttaagatgcgataggggacgagggatggttagtgaggcgggaagagggtcggttttcgaggttttaaaggggtaacggagaagtagcggggcgcggagggcgtgtaggttgagtgtcgcgggataggcgcgatattggtgttggcgttggcgttatagatttagggttgcggcgtgttttttggtttttagtttgagatcggcgatgttggagtttttgttggtggttttggcggttgttgcggtcgttattatcgaggcggcggaagtcgaattcgcggttagcgtggcgagcggtagttcgaagggcggtgttgggaatattatgtagggcgcgtgcgcggttaggtgcggatgtaggtggtggtgcgcgtgcgttatagcgttgtttagttgtagttgcgtttgaatttgaaaggataagggcgttacgttgtaatgattattttagggtgataatagaatagaaatagagtattaacggcgtttagtttggttagagagagagttgggttgtgtttgggtacggggagagggtatttggttgtgtattttgtttcgatagtgatttttttagtttgttgttgaatttggggttttatatggatattttagtgttttttgggttttcgaaattcgtttagggtaggtttattttttcggatttcgggaatttttttttgtaggaatgtggtcgttttttttgggaattgggttgaaatggtatattggaaagattgcgggtgaggatttttattttttttttttgatgttgttatgtattttttattttattattaaaataacggagtattaataagtaaattacgtaattttttaatgttatttagggaagttattttatttttattataataggtataattgtgagtcggtatttttaatttttattgttataataattatttagggatttcgttaaaatttagattttgattcgtaaggtttaggttggggtttgagattttgaatttttaataattttttagacggtgttgttgttgttggtttaaagattattttttgagtagtaaaggtttttttttaaagttatttttttttttttttttagttatttttttttgtttttaaagttaagtattaggatgttagagttttgtggtattaagagagttaagatttttttaatatcgatttttaatttatggttatatttatttgttttttcggtttaagttattggagattgagagttaatttatgatattataggtatgttaagtaggggttttggttgaggatagggaaggttagatattggttgggaaaggatttcgtttttaggtttggaaagtggggagtttagagtattgggattttttaggattaaattattgttgtaggttgtttttttaaaatgtatttttaaaggtttttttatggttaagggattgtaaaggtagggtagttttgggaagattaagatttttttttttattagagatgaagttttgtttgtagaaatagatttaaaaataaaagaacgaaaaaataaaagtatgagttgggagtatttgtgtttattttttttttgttagagttatttaatgtgattaagaggtagaaaatatttagaaaagtatttagagggttgttttagaaatattttaggattaatttttgtattggatttgataaaattttaattaaaaggttttttttttttttttttttaagggtaatttttagtgtatttttaaaggattagttattgtttttaggtttttttagggatttttatgaggatagaagggattaggtatttaggtttttaatatcgtataggtttttaaagggtagtgggtttattatattattttaaaatgattttttaattatgtagatattgatatttgggtttagagataggtgatgtttaatagtttaagtaaatatttaggtatttttatatttaaaaatagtttgaaattaggttgtatttgtttgttgaaatggtatttttaaagtatttacgttgatataaggtgcgattttataagttttaaattggttggcggtttttatgagaatatttgtaaaaagtataagagaaaaataatgtgaggttaacgtttgtagtattttttagggttttaaagggtataagatagaacgaatttttttgaaaatggattattatttttttaaattgtatttaaaatttaaataaatgtaatttatttttaaattttaggattttattaatagtttttgaagattattaagttaagaattattgttatttttgaggtttttttttttttgttattgtaatagtaatatttattatttttttttttgtttagattattaaatgttttttgtataagaagtatatttttatggagttgatttttttgttttttatatttagtttttcgattttgaaattaaatttataggttggagggggaaaaaaaataaaatttagatgttatgattaaaaatttttttaaattataaaagtataaagagaaaagagtcgtggtttagataagaattgggagatatagtaagtaatttttgaattgtataaaatagttttaaattttaaagttaaatatgtaaattaattatagaaatagaaagatagattttatagatttttataagatagattattattagttttgattttatttttttatataatagagtttttatggtttaaaattttgtttggtatttgatattaatatgataatggtttagatatttgtttagttaagatttgagaagaatgtgtttattaatagtttgtaatgttaattagttttattttaaagaaaaattaaatattagagtaaataatgatttttttgcggagaaggagttgtaagggttggggagaggtaattagtgttataaaagttttattataaagaagtttagaatttttttgttttgttgtgtagtagagtgaaatatagtagtagaataattgtgtattattattatgataatttaatttgtttttttagaaaaagttattgtttgtagttaggatagtaggaaaatatttagaaaataattaaaatgtaaataaaagtatgaaataataataaagtttattttttaagagaaaaaaagaagagtatttagcgaaaggagaatgaagtatatataaagtaagtaatttttaggtattttgtttttttggatgttatttgtttaaatttgataatttttataggtagtatgatagattttttaaaatttaaataaagtttgtttttgtattttatttttaataataaagtatattgattgatttataaattaaagtttttaaaattttattaaagtaaaaatattgttttagagtttttattggtatgtttttgaaagtaagtgttatagttaatgtaaatttttaaaaatttttttgttatttagtataatagagggtggattttgtgttagggtggtattttttgtgtaatttatatggtttgaggttttttgttttttttttttttagaagagttggaattaagatattaataattataattgtaataattattattatgtttttaaggggttgttgagtttttggagattttagtgtatagagcgaagtaggagaggtttaaaaaggaaggttttgttgttgatgttgtgatgattaaggtagtttattattattttttttttttaacgtgattgttttgttttttttttttttgattttgttataagatgtggggaagttttttaagaattgtgtatagttcgttatagatggtggtttttgtgtttagagatcgaaagagtatttgttatagcgatattttgtaatagttgtagatgtgcgggtttaaaattgttttatgtgtttaaattaataataattattattttattttattttattatttgagcggaaatataatttgaaatatttaaatttgttttttttaaagttagaaggatatgtgtatgtgaatgtatataatttgtttttttaaatgtttttaaagtttatttttgttattatatttgtttttataattaataaagaaaatttgttttagttttaattttattgggtatggtacgtgttggagggtaggttttggaaatataaatattaatatatgtggtttgttttaaaatttaatgtatttagggttagtttcgttgttttggttaaatgaatgaataaagagtgattaaaatgcgtttattttttcgttattttatatatagtttgagatcgatcgttaatagtagattgtaaatttttgtatttaatagttattaattttttttatagtttgtatatttataaatttaattgggatattcgtttgataaatttagattttgtagagtagatttttaaggaaatttaattttagagaataaaatattttttggaatttttaaggtatttagagataaaacgttttttgtgggatttttttttaagttttataaaagtaggtttattaggattaaattatattaaagttagtgcgaggtaaggggggtgtggtttatagaaattttgggagaaagtttagtatagttttttttttttgggaatatatgttaggatggaaaaaaaaaaaaggaggggagtgttataggattaagatttattttggaaaataagatttttagtaaagatattttttttttttttattttatattagatattagaagtattatttttcgagtgtgttttttaagtttttttttaattttaggttttttttgttttttgggttttcgattttttggtagttgggtatttgtattcgggttttcgataggtttagtcgttggtttagtttttttcgtatgaaggcgtcgggatagtgggtttcgttaaaaagtttttttagtttattgagttgttttagggtgaaattggttcgatttcgtttttgtttgattttggtttggttttcgttttttatttttttcgtattttttttgcgattttttagtttcggggatattggagggggtattttagcggggttatacgtgtatttatacgaatatatatatatacgtatatatatacggacgaaaatagtatagtaaattttgttattagatttgtcgtaaaaaagaatagagaatttttttttttcgtggaattttggttcggttttttaatttattcggaggaagaatatttcggagaagcgtaaaggttaagtttgagcggtcgtttggggtaaggtgggtagttatttattattttttttataaacgtatttcgatttatcgttttattatttattttttagttatcggttttttttagtaaatattaaatggtttttatttattttcgtatttatttgtttcgtagtatttatagaaattaaaggcgtagcgttaggttttttatagagtaaagtttggatataagggcgcggtaaggttatttattggttttttatatcggttatttttagaaggttggttcgtttttaggttagtttttattatcgttggttttttgtttatcgtaaatttgttggtttaatttaggaataattgggtcgaaaggtattagcgagagtaatagatttcggtgttgtgtcgtatagggagtcgtattcgtagacgtttttcgttgtttttgggttcgggttaaattttgtataaggttttttggatagttaggtaattttcgtttcgtttgttcgatcggggtcgtacgagtataggcgtttacgttatgttggttgtttaaagggttcgtcgtttaagtcgggttagaaggtaggaggcggaaaattagttttcggtggcgggcgaaagtaatcgttttttttgtttttttttcgttttttttcgtggaaacgtagattcgattttaaacgtttaatttatagagattaataggtttaagcggaatattcgcgattttcggtttttattggttgtttaaagtttttttatgtaattagtagttcggatgtttaataaaatatgaatttttttgttttgggtttgtatatattcgttgttatttttttgttttttttttttttttaaaaataggagtttttttagtgtgagtatatatagttattatatatatatttttttggaatttttattttttgcgttcgaattagagatttcgggttttaagaagttaaagttgagtttagatagtcgaggttgtttgtagttttttttagcgtaggatttaggttagtatgggtgttaaaaattattttcggaagagtcggtttgtagagaaattaatatttgttttgagtttggaaattaataattttaggaattgcgttcgtcgggggtttagatttgaatttcgtcgttaggcgcgttggcgaatttgtagttcgggtttgtagttgtggatttatggtcgggaggttgtattgggtattttgacggtaattttattattttataaatttaggaagatttggtgttggtttggaggaagaagagtcgttagatttcggttttgtcgggtattttagttacggtgattttaaatattgtcgtattttttagtttttagagttagttttgtggatatttgttttttttttaggaaggaatattatagtaaatattatgggttaatttaatagtaaagtatttttattgatattgtattgaaatttaaatatgaaaatatattttttaaattttgttaatgaggtgggaaggttttgtttattatatgttatttatatagtggatgttatttaaagttttggggtttcgaggagatgtttaaattttaagttgatttatagatttaataaaatttttatttttgtttttaaatttttaattattgatttaaataggaatagatcgtgttataaataatttaattgtttgtttaaatatgtgattttacgtatgttatatatttttttaattggaaaaatatggtagtatattagttattgtaggtattaagtgttaaattaattttattgttgaatttttttgaattggtatagaacgttttgttattgagataaagacgttttttaatattgagttagtattaaaggatttttgttttaagagaatcgagtattgggtgattgaaaatattaaaggaattgtgtaaatatagatttttatttttttcgtcgtttttttttttcgtttttaatatattaagaaatcgaaacgtttcgttcgggagaagtagcgtagtttggattttagttttcgttggtttttttttattttgaaagagaatgggaagttttggtttttaagatttaaagatttaggggttttgcggagttcgaggggttttggcggttttaaatatttaggcgatcggagggttaagttttttatttttgttttttttttttttcggtaaattttgcgttagaggttagttttagtttcgtcgtttggtttagtatttttttttgtagttcggtttcgcgaatttttacgttcgtttgcgggttattcgggttgcgggtttattttttcgttggtgaaaaatgtatttcggtggaatgggaatatttgggaagggcgcgtataaattttatacgtttttttttacgttatttttataatatattaggattttatttatgatcgagtatattatcggatttttatttttttattattattttagttgataaagttggggtttagggtttttttcgtgtttttttttttttttcgttgggtttcggagttttttttcgttcgagaggagttcggaaggcgggaaggggaatcgttgtcgggggttagttaggtcgttatttttcgttagtcgcgggttgttcggttttttgtttttttcggcggcgtttatgtttagttttcggacgggagagcgtttttttttagttttttcgtttgttttttttttttttatatttttttcgtttttttcgtcgtcgttttcgtttttttcgtcgtcgttttcgtcggtcgttcggattgtcgggttgttgcggtcgtcgcggttcgtttcggtgtagtcggtcggttttttggtttcgcgtagcggttcgttttttagtatttttcggtacgtgatcgtttttttttttttttttattttttggttaaaagatttggagacgaacgtcgtaagtttttttatcgtcgtcgtacgttagttcggcgtttaatttttgttagtagagtttcgtttttttttttttttttttttttttattgttttagtttttttaataataatatattaatgggataggaggtgggggaggagagggaggaggagaaagaagaagaaaaagaggagaagaaagaagaaagaggaggagaagtagaaggagaaaaagaagtaagaagaggaggaggaggaagaagaggaagagggggagaagggtgaagaggagagggaggaggaggaggagaagagaaggggcgggggttgtcggagggaaatgggaattgatgtttttttgtcggagcgcgtttgtttaatgttaagatttttgataattttttttgcggagagtttagatttgatagcgacgttgcgtttgaagttttattatttatattttttaacggcggttttttgttttgagtaaattattttttttcgtaattcggagtgagtttttttttcgggtagtagtcgcgtttttatcgggggttggggaggggaaaaggagagaaatagagagagagagagagagagagagagagagagagagagagagagagagaagaggagagagagagattggagttcgggcgggttggggttggagtggtagggtagtatagggggatcggagggggcggggagagaaggtcggttttcggtcgtttaggtttttagatagtttttgtcgtttgtgtttttggttattaatttaggattgataagaatttttaattaatttaattaggcgtggattttgcgttggtgttacgatttagttaaatattggggagttggatagatttcgcggggtggggttaagaggaaattgataagtgcgtagtttttagagttagttaggtatttcgatattgtatttttttttatagttttgtttcgagttagggtgtttcgtaatgtttagtttcgtattgttttttttcgtttttgttttgtattaatcgtttagtagtttataggtttcgtattttattttcgtattttgatttcgtattttaattttgtattttcgttttttttttataattttatttttgtcggtcgtagttttatcgtttagtattattttgtttagagatagggttgtttgtatttttttcgattcgcgtagttttttttaggagtttttcggttcgtaggtaggttgagttcgggttttttttaagtttttcgtttttcggttcgtgttattcgttttattattcgtgttttggagtttagttgatttttttatggatagatttcgttaaaagggattagtcgatttaataagtttttttagtagttgttagttgatagattttattttaaagtgtttttttagcgttcggttaaggatagttcgatttcgttcgttttttttttgaggttttagaatttttattttttttttttattttttgtattcggatttttttatggtgaattataggattttttttttagtattttgggaaatattcgagtttatttattaatttgaaaaataagagattattttttttcgagtttgaaaaaaaaatcgacgttaagtttgtattttttttaattttatttattacggagagttaaaaaagagacgttcgttaggagtaaaggtttttttgtttattttttttattatttcgtttacgatttaaaattttatttttgggttatttttatcggaacggtttgttacgttagaggaatatttatatttttgagttatttgtttgtattgtgtcggatagggtttgttgtgagaagtgtggttatgtaaatatatatttataaaagaatatttatatatgatgttatatttaagtgtgtaaataaatatatttttaagtgtggtttaggggatatttttaagtattttgaatattaatgtagattttttggaagttaaaggtaatttgattattattttggatttaatatttttagtaaaaataagaggaattatagaatattaatatgtatatttttcgtatattggttaaggtattaaaataaattagtagataatttaagaagtttcgttaaaataatttgaaatatttgtaaaaagagaatataattataatttaatatattagtgttttttaaatagatgtagatagaagttggatataattttatgttatattataatatttatattaaaatgtttatgtttggtgagtttaaggattatgtatattatgttttttagaaacgttgttttttttttttaaaatattttattttttgttatttttaggagagttaatgtttataattttttcgtagttatagtttttaggtatgaatatattgttattagtatttgtttttgttttgttatattataaaagggataaagttttaaagttatacgaatttagaaataattttatattgagttttgggttattttttgtaattattttttgatattattagaggaaaataattatataattttagttttttatgaaaatttgtttttaagattatttagtagaagggttagtaatagggagagttaagaggatacggtgtttaaggtgtttttaaattgaggtgttaaatatatatttataaataatttaaaaataattattgttagaagtcggttaaggaattaggagatttattagttatttgtttgtttttttaagtatatgatttttaggtttgaagttatattttatttattgagtttgagggaaagatgattattttgaaggtaattagggaagttatagatataattattgtgtaatttaaattaataaatttttttatgattttagttttttggtttattgtatatttaggaatagtagtgttgataatagatggagttatgagaaatttttagtgtttgattatagatttttattggtttaagggaagttattttaaaaaatattttaaggttttaaatttatatattaataaatgtttataaagttttaatgatgttgttttattaaatagtaaatattttttagaaatagggtattttaaaatatagtttttgtttaaaaaaaaaaaaaagtatttatggtaaagtttagttgatagtttgtggatagatgtataggttttaataaaatttaggattttaagggtttttttagtttttgaattatttaaaatatatacgtagtgttgtagtagttaagttttaaaacggtgttttaaaattggttagttaaggtatattatttacgaaaaatatattgtggaggtgattttttattattttaaatgtttgcggaaaattgtagtttggttatttagtagtggtgaatgagttgatttttatagtcgattaaaatttaggttaataatttatttatttttttagttttgtttaagagtaaatgaggaaaaaatttttatgtaaggaaaaataagtaatgtagtatgaattatagaaaatgttgagtttttttaatttttattggtttaaataaaaaaattttatatatttataaatttgagtttttttttagaagaaatcgtttttcgtttcgttttaggtagtttttttttatttttttattaattagttattttaatttgagaaattaatttgtatttaatttgtgagtgtttttatttttagggtagaagaaatatcgatttttaatgtatttttgtaaataaattattataatttaattatatacgattttatatagatatatttttatgatttattatcgttgggcgagttttttttttttttagcgtgagataattaattttgtttcgggtaggtgttataaataaaattttttacgatgtagatttgtttattgattatttatgacgataacgacgattattaagataataatattttttagttttatttttattgtttttggtaataataaaattaaaataaataggtacgtaaaataaacgttaaataaaaaatcggtcgcgttataatttattttttcggtatttttagcgtttggtagcgtttatcgatgtattcgatatttcggttgaagttgtttggcgttagaattaggaaggcgttgagtttaaattgaagtaagttcggtggacgtcggcggcgttttgatttaaagaaacgatttagggattgcggcgtttgtacgttaacgggaggtgtgagtttaaaggtttggatttaggtgatgtttacgattagggtttggggagcggtagtcgtggttgcggagtttcgaggttttgattcggcgagaggcgacgcggggtttggcgtagtttgcggtttagtgtttgtggagggtgggttgcggtttcggggcgtgcgtagtgttatcgtgcgtatgcgtttcgtatttgggaggtttcggattttttgggttaaggttggtggttgtagggtgggtgggtggtcgtaggttttaagtttggttttttgttttgaggatatgtcggagagttcgtcgattttttttttcgttttacgtttttggttttttatagttgtttttgggttttttggtttattttgtaatataagtttggcgtttttttattagttttaggtagggtggagtaagagggaggttggattttggtgttttttattttatttattttattgtttttgttttagatttagttttttttttgatttcgttttattttttttggtttatattggtttgttgagagaagtggtgtagggtgaaatagatgttttttttttgaaatataaatatgttcgttttaaatatattatatatttttttgatttttgtattggtggtatgtgattaagagtatatggttttgtttatttttgtaagatgttataatgtatcgtaaggtatgttgtttgtttttgattttaggttaattttgacgtaattttttttttagaggttgtgtatttttaaatgtatattggaaatttaaataaaaaaatatttttttatatttttagaattagtagtaatttaattgtgttttagttaattaggtagtagataaataaatttaaatgttttatgttgttataagaaagtattcgagttgttatttttgaatttagatgtattataaaagttttaagtgaaggaggtaagtagagtttttaggtttaagatttggagtaggtgtgatagttgtaattttgggggaaattaggtattttttaagagtttttttagttttagagtttataaatatttattttttttgtaggtaaagattttatgttaagtgatataatattttatgttttttaataagagggttaaaaatgttagaatttgaaacgataaaaatagttggtattttttgttaattggttttgttaatttaattagttttataaagaggggtgttatgaattggaaaagttttgaaagcgggttgtttatagtagatttatagttgtattttttgtttttatgtttaaattattggggataaattttta

SEQ ID NO: 103 - DNA, 20550 bp, Artificial Sequence
  bisulfite converted genomic DNA
taaaaatttatccccaataatttaaacataaaaacaaaaaatacaactataaatctactataaacaacccgctttcaaaacttttccaattcataacacccctctttataaaactaattaaattaacaaaaccaattaacaaaaaataccaactatttttatcgtttcaaattctaacatttttaaccctcttattaaaaaacataaaatattatatcacttaacataaaatctttacctacaaaaaaaataaatatttataaactctaaaactaaaaaaactcttaaaaaatacctaatttcccccaaaattacaactatcacacctactccaaatcttaaacctaaaaactctacttacctccttcacttaaaacttttataatacatctaaattcaaaaataacaactcgaatactttcttataacaacataaaacatttaaatttatttatctactacctaattaactaaaacacaattaaattactactaattctaaaaatataaaaaaatatttttttatttaaatttccaatatacatttaaaaatacacaacctctaaaaaaaaaattacgtcaaaattaacctaaaatcaaaaacaaacaacataccttacgatacattataacatcttacaaaaataaacaaaaccatatactcttaatcacataccaccaatacaaaaatcaaaaaaatatataatatatttaaaacgaacatatttatatttcaaaaaaaaaacatctatttcaccctacaccacttctctcaacaaaccaatataaaccaaaaaaaataaaacgaaatcaaaaaaaaaactaaatctaaaacaaaaacaataaaataaataaaataaaaaacaccaaaatccaacctccctcttactccaccctacctaaaactaataaaaaaacgccaaacttatattacaaaataaaccaaaaaacccaaaaacaactataaaaaaccaaaaacgtaaaacgaaaaaaaaaatcgacgaactctccgacatatcctcaaaacaaaaaaccaaacttaaaacctacgaccacccacccaccctacaaccaccaaccttaacccaaaaaatccgaaacctcccaaatacgaaacgcatacgcacgataacactacgcacgccccgaaaccgcaacccaccctccacaaacactaaaccgcaaactacgccaaaccccgcgtcgcctctcgccgaatcaaaacctcgaaactccgcaaccacgactaccgctccccaaaccctaatcgtaaacatcacctaaatccaaacctttaaactcacacctcccgttaacgtacaaacgccgcaatccctaaatcgtttctttaaatcaaaacgccgccgacgtccaccgaacttacttcaatttaaactcaacgccttcctaattctaacgccaaacaacttcaaccgaaatatcgaatacatcgataaacgctaccaaacgctaaaaataccgaaaaaataaattataacgcgaccgattttttatttaacgtttattttacgtacctatttattttaattttattattaccaaaaacaataaaaataaaactaaaaaatattattatcttaataatcgtcgttatcgtcataaataatcaataaacaaatctacatcgtaaaaaattttatttataacacctacccgaaacaaaattaattatctcacgctaaaaaaaaaaaaaactcgcccaacgataataaatcataaaaatatatctatataaaatcgtatataattaaattataataatttatttacaaaaatacattaaaaatcgatatttcttctaccctaaaaataaaaacactcacaaattaaatacaaattaatttctcaaattaaaataactaattaataaaaaaataaaaaaaaactacctaaaacgaaacgaaaaacgatttcttctaaaaaaaaactcaaatttataaatatataaaatttttttatttaaaccaataaaaattaaaaaaactcaacattttctataattcatactacattacttatttttccttacataaaaattttttcctcatttactcttaaacaaaactaaaaaaataaataaattattaacctaaattttaatcgactataaaaatcaactcattcaccactactaaataaccaaactacaattttccgcaaacatttaaaataataaaaaatcacctccacaatatatttttcgtaaataatataccttaactaaccaattttaaaacaccgttttaaaacttaactactacaacactacgtatatattttaaataattcaaaaactaaaaaaacccttaaaatcctaaattttattaaaacctatacatctatccacaaactatcaactaaactttaccataaatacttttttttttttttaaacaaaaactatattttaaaataccctatttctaaaaaatatttactatttaataaaacaacatcattaaaactttataaacatttattaatatataaatttaaaaccttaaaatattttttaaaataacttcccttaaaccaataaaaatctataatcaaacactaaaaatttctcataactccatctattatcaacactactattcctaaatatacaataaaccaaaaaactaaaatcataaaaaaatttattaatttaaattacacaataattatatctataacttccctaattaccttcaaaataatcatctttccctcaaactcaataaataaaatataacttcaaacctaaaaatcatatacttaaaaaaacaaacaaataactaataaatctcctaattccttaaccgacttctaacaataattatttttaaattatttataaatatatatttaacacctcaatttaaaaacaccttaaacaccgtatcctcttaactctccctattactaacccttctactaaataatcttaaaaacaaattttcataaaaaactaaaattatataattattttcctctaataatatcaaaaaataattacaaaaaataacccaaaactcaatataaaattatttctaaattcgtataactttaaaactttatcccttttataatataacaaaacaaaaacaaatactaataacaatatattcatacctaaaaactataactacgaaaaaattataaacattaactctcctaaaaataacaaaaaataaaatattttaaaaaaaaaaaacaacgtttctaaaaaacataatatacataatccttaaactcaccaaacataaacattttaatataaatattataatataacataaaattatatccaacttctatctacatctatttaaaaaacactaatatattaaattataattatattctctttttacaaatatttcaaattattttaacgaaacttcttaaattatctactaatttattttaataccttaaccaatatacgaaaaatatacatattaatattctataattcctcttatttttactaaaaatattaaatccaaaataataatcaaattacctttaacttccaaaaaatctacattaatattcaaaatacttaaaaatatcccctaaaccacacttaaaaatatatttatttacacacttaaatataacatcatatataaatattcttttataaatatatatttacataaccacacttctcacaacaaaccctatccgacacaatacaaacaaataactcaaaaatataaatattcctctaacgtaacaaaccgttccgataaaaataacccaaaaataaaattttaaatcgtaaacgaaataataaaaaaaataaacaaaaaaacctttactcctaacgaacgtctcttttttaactctccgtaataaataaaattaaaaaaaatacaaacttaacgtcgatttttttttcaaactcgaaaaaaaataatctcttatttttcaaattaataaataaactcgaatatttcccaaaatactaaaaaaaaaatcctataattcaccataaaaaaatccgaatacaaaaaataaaaaaaaaaaataaaaattctaaaacctcaaaaaaaaaacgaacgaaatcgaactatccttaaccgaacgctaaaaaaacactttaaaataaaatctatcaactaacaactactaaaaaaacttattaaatcgactaatcccttttaacgaaatctatccataaaaaaatcaactaaactccaaaacacgaataataaaacgaataacacgaaccgaaaaacgaaaaacttaaaaaaaacccgaactcaacctacctacgaaccgaaaaactcctaaaaaaaactacgcgaatcgaaaaaaatacaaacaaccctatctctaaacaaaataatactaaacgataaaactacgaccgacaaaaataaaattataaaaaaaaaacgaaaatacaaaattaaaatacgaaatcaaaatacgaaaataaaatacgaaacctataaactactaaacgattaatacaaaacaaaaacgaaaaaaaacaatacgaaactaaacattacgaaacaccctaactcgaaacaaaactataaaaaaaaatacaatatcgaaatacctaactaactctaaaaactacgcacttatcaatttcctcttaaccccaccccgcgaaatctatccaactccccaatatttaactaaatcgtaacaccaacgcaaaatccacgcctaattaaattaattaaaaattcttatcaatcctaaattaataaccaaaaacacaaacgacaaaaactatctaaaaacctaaacgaccgaaaaccgaccttctctccccgccccctccgatccccctatactaccctaccactccaaccccaacccgcccgaactccaatctctctctctcctcttctctctctctctctctctctctctctctctctctctctctctctctctatttctctccttttcccctccccaacccccgataaaaacgcgactactacccgaaaaaaaaactcactccgaattacgaaaaaaaataatttactcaaaacaaaaaaccgccgttaaaaaatataaataataaaacttcaaacgcaacgtcgctatcaaatctaaactctccgcaaaaaaaattatcaaaaatcttaacattaaacaaacgcgctccgacaaaaaaacatcaattcccatttccctccgacaacccccgccccttctcttctcctcctcctcctccctctcctcttcacccttctccccctcttcctcttcttcctcctcctcctcttcttacttctttttctccttctacttctcctcctctttcttctttcttctcctctttttcttcttctttctcctcctccctctcctcccccacctcctatcccattaatatattattattaaaaaaactaaaacaataaaaaaaaaaaaaaaaaaaaaaaaacgaaactctactaacaaaaattaaacgccgaactaacgtacgacgacgataaaaaaacttacgacgttcgtctccaaatcttttaaccaaaaaataaaaaaaaaaaaaaaaacgatcacgtaccgaaaaatactaaaaaacgaaccgctacgcgaaaccaaaaaaccgaccgactacaccgaaacgaaccgcgacgaccgcaacaacccgacaatccgaacgaccgacgaaaacgacgacgaaaaaaacgaaaacgacgacgaaaaaaacgaaaaaaatataaaaaaaaaaaaaacaaacgaaaaaactaaaaaaaaacgctctcccgtccgaaaactaaacataaacgccgccgaaaaaaacaaaaaaccgaacaacccgcgactaacgaaaaataacgacctaactaacccccgacaacgattccccttcccgccttccgaactcctctcgaacgaaaaaaaactccgaaacccaacgaaaaaaaaaaaaaaacacgaaaaaaaccctaaaccccaactttatcaactaaaataataataaaaaaataaaaatccgataatatactcgatcataaataaaatcctaatatattataaaaataacgtaaaaaaaaacgtataaaatttatacgcgcccttcccaaatattcccattccaccgaaatacatttttcaccaacgaaaaaataaacccgcaacccgaataacccgcaaacgaacgtaaaaattcgcgaaaccgaactacaaaaaaaaatactaaaccaaacgacgaaactaaaactaacctctaacgcaaaatttaccgaaaaaaaaaaaaaacaaaaataaaaaacttaaccctccgatcgcctaaatatttaaaaccgccaaaacccctcgaactccgcaaaacccctaaatctttaaatcttaaaaaccaaaacttcccattctctttcaaaataaaaaaaaaccaacgaaaactaaaatccaaactacgctacttctcccgaacgaaacgtttcgatttcttaatatattaaaaacgaaaaaaaaaaacgacgaaaaaaataaaaatctatatttacacaattcctttaatattttcaatcacccaatactcgattctcttaaaacaaaaatcctttaatactaactcaatattaaaaaacgtctttatctcaataacaaaacgttctataccaattcaaaaaaattcaacaataaaattaatttaacacttaatacctacaataactaatatactaccatatttttccaattaaaaaaatatataacatacgtaaaatcacatatttaaacaaacaattaaattatttataacacgatctattcctatttaaatcaataattaaaaatttaaaaacaaaaataaaaattttattaaatctataaatcaacttaaaatttaaacatctcctcgaaaccccaaaactttaaataacatccactatataaataacatataataaacaaaaccttcccacctcattaacaaaatttaaaaaatatattttcatatttaaatttcaatacaatatcaataaaaatactttactattaaattaacccataatatttactataatattccttcctaaaaaaaaaacaaatatccacaaaactaactctaaaaactaaaaaatacgacaatatttaaaatcaccgtaactaaaatacccgacaaaaccgaaatctaacgactcttcttcctccaaaccaacaccaaatcttcctaaatttataaaataataaaattaccgtcaaaatacccaatacaacctcccgaccataaatccacaactacaaacccgaactacaaattcgccaacgcgcctaacgacgaaattcaaatctaaacccccgacgaacgcaattcctaaaattattaatttccaaactcaaaacaaatattaatttctctacaaaccgactcttccgaaaataatttttaacacccatactaacctaaatcctacgctaaaaaaaactacaaacaacctcgactatctaaactcaactttaacttcttaaaacccgaaatctctaattcgaacgcaaaaaataaaaattccaaaaaaatatatatataataactatatatactcacactaaaaaaactcctatttttaaaaaaaaaaaaaaaacaaaaaaataacaacgaatatatacaaacccaaaacaaaaaaattcatattttattaaacatccgaactactaattacataaaaaaactttaaacaaccaataaaaaccgaaaatcgcgaatattccgcttaaacctattaatctctataaattaaacgtttaaaatcgaatctacgtttccacgaaaaaaaacgaaaaaaaaacaaaaaaaacgattactttcgcccgccaccgaaaactaattttccgcctcctaccttctaacccgacttaaacgacgaaccctttaaacaaccaacataacgtaaacgcctatactcgtacgaccccgatcgaacaaacgaaacgaaaattacctaactatccaaaaaaccttatacaaaatttaacccgaacccaaaaacaacgaaaaacgtctacgaatacgactccctatacgacacaacaccgaaatctattactctcgctaatacctttcgacccaattattcctaaattaaaccaacaaatttacgataaacaaaaaaccaacgataataaaaactaacctaaaaacgaaccaaccttctaaaaataaccgatataaaaaaccaataaataaccttaccgcgcccttatatccaaactttactctataaaaaacctaacgctacgcctttaatttctataaatactacgaaacaaataaatacgaaaataaataaaaaccatttaatatttactaaaaaaaaccgataactaaaaaataaataataaaacgataaatcgaaatacgtttataaaaaaaataataaataactacccaccttaccccaaacgaccgctcaaacttaacctttacgcttctccgaaatattcttcctccgaataaattaaaaaaccgaaccaaaattccacgaaaaaaaaaaattctctattcttttttacgacaaatctaataacaaaatttactatactattttcgtccgtatatatatacgtatatatatatattcgtataaatacacgtataaccccgctaaaataccccctccaatatccccgaaactaaaaaatcgcaaaaaaaatacgaaaaaaataaaaaacgaaaaccaaaccaaaatcaaacaaaaacgaaatcgaaccaatttcaccctaaaacaactcaataaactaaaaaaactttttaacgaaacccactatcccgacgccttcatacgaaaaaaactaaaccaacgactaaacctatcgaaaacccgaatacaaatacccaactaccaaaaaatcgaaaacccaaaaaacaaaaaaaacctaaaattaaaaaaaaacttaaaaaacacactcgaaaaataatacttctaatatctaatataaaataaaaaaaaaaaaaatatctttactaaaaatcttattttccaaaataaatcttaatcctataacactcccctccttttttttttttccatcctaacatatattcccaaaaaaaaaaaactatactaaactttctcccaaaatttctataaaccacaccccccttacctcgcactaactttaatataatttaatcctaataaacctacttttataaaacttaaaaaaaaatcccacaaaaaacgttttatctctaaataccttaaaaattccaaaaaatattttattctctaaaattaaatttccttaaaaatctactctacaaaatctaaatttatcaaacgaatatcccaattaaatttataaatatacaaactataaaaaaaattaataactattaaatacaaaaatttacaatctactattaacgatcgatctcaaactatatataaaataacgaaaaaataaacgcattttaatcactctttattcattcatttaaccaaaacaacgaaactaaccctaaatacattaaattttaaaacaaaccacatatattaatatttatatttccaaaacctaccctccaacacgtaccatacccaataaaattaaaactaaaacaaattttctttattaattataaaaacaaatataataacaaaaataaactttaaaaacatttaaaaaaacaaattatatacattcacatacacatatccttctaactttaaaaaaaacaaatttaaatatttcaaattatatttccgctcaaataataaaataaaataaaataataattattattaatttaaacacataaaacaattttaaacccgcacatctacaactattacaaaatatcgctataacaaatactctttcgatctctaaacacaaaaaccaccatctataacgaactatacacaattcttaaaaaacttccccacatcttataacaaaatcaaaaaaaaaaaaaacaaaacaatcacgttaaaaaaaaaaaataataataaactaccttaatcatcacaacatcaacaacaaaaccttcctttttaaacctctcctacttcgctctatacactaaaatctccaaaaactcaacaaccccttaaaaacataataataattattacaattataattattaatatcttaattccaactcttctaaaaaaaaaaaaaacaaaaaacctcaaaccatataaattacacaaaaaataccaccctaacacaaaatccaccctctattatactaaataacaaaaaaatttttaaaaatttacattaactataacacttactttcaaaaacataccaataaaaactctaaaacaatatttttactttaataaaattttaaaaactttaatttataaatcaatcaatatactttattattaaaaataaaatacaaaaacaaactttatttaaattttaaaaaatctatcatactacctataaaaattatcaaatttaaacaaataacatccaaaaaaacaaaatacctaaaaattacttactttatatatacttcattctcctttcgctaaatactcttctttttttctcttaaaaaataaactttattattatttcatacttttatttacattttaattattttctaaatattttcctactatcctaactacaaacaataactttttctaaaaaaacaaattaaattatcataataataatacacaattattctactactatatttcactctactacacaacaaaacaaaaaaattctaaacttctttataataaaacttttataacactaattacctctccccaacccttacaactccttctccgcaaaaaaatcattatttactctaatatttaatttttctttaaaataaaactaattaacattacaaactattaataaacacattcttctcaaatcttaactaaacaaatatctaaaccattatcatattaatatcaaataccaaacaaaattttaaaccataaaaactctattatataaaaaaataaaatcaaaactaataataatctatcttataaaaatctataaaatctatctttctatttctataattaatttacatatttaactttaaaatttaaaactattttatacaattcaaaaattacttactatatctcccaattcttatctaaaccacgactcttttctctttatacttttataatttaaaaaaatttttaatcataacatctaaattttattttttttccccctccaacctataaatttaatttcaaaatcgaaaaactaaatataaaaaacaaaaaaatcaactccataaaaatatacttcttatacaaaaaacatttaataatctaaacaaaaaaaaaaataataaatattactattacaataacaaaaaaaaaaaaacctcaaaaataacaataattcttaacttaataatcttcaaaaactattaataaaatcctaaaatttaaaaataaattacatttatttaaattttaaatacaatttaaaaaaataataatccattttcaaaaaaattcgttctatcttataccctttaaaaccctaaaaaatactacaaacgttaacctcacattatttttctcttatactttttacaaatattctcataaaaaccgccaaccaatttaaaacttataaaatcgcaccttatatcaacgtaaatactttaaaaataccatttcaacaaacaaatacaacctaatttcaaactatttttaaatataaaaatacctaaatatttacttaaactattaaacatcacctatctctaaacccaaatatcaatatctacataattaaaaaatcattttaaaataatataataaacccactaccctttaaaaacctatacgatattaaaaacctaaatacctaatcccttctatcctcataaaaatccctaaaaaaacctaaaaacaataactaatcctttaaaaatacactaaaaattacccttaaaaaaaaaaaaaaaaaaaaccttttaattaaaattttatcaaatccaatacaaaaattaatcctaaaatatttctaaaacaaccctctaaatacttttctaaatattttctacctcttaatcacattaaataactctaacaaaaaaaaaataaacacaaatactcccaactcatacttttattttttcgttcttttatttttaaatctatttctacaaacaaaacttcatctctaataaaaaaaaaaatcttaatcttcccaaaactaccctacctttacaatcccttaaccataaaaaaacctttaaaaatacattttaaaaaaacaacctacaacaataatttaatcctaaaaaatcccaatactctaaactccccactttccaaacctaaaaacgaaatcctttcccaaccaatatctaaccttccctatcctcaaccaaaacccctacttaacatacctataatatcataaattaactctcaatctccaataacttaaaccgaaaaaacaaataaatataaccataaattaaaaatcgatattaaaaaaatcttaactctcttaataccacaaaactctaacatcctaatacttaactttaaaaacaaaaaaaaataactaaaaaaaaaaaaaaaaataactttaaaaaaaaacctttactactcaaaaaataatctttaaaccaacaacaacaacaccgtctaaaaaattattaaaaattcaaaatctcaaaccccaacctaaaccttacgaatcaaaatctaaattttaacgaaatccctaaataattattataacaataaaaattaaaaataccgactcacaattatacctattataataaaaataaaataacttccctaaataacattaaaaaattacgtaatttacttattaatactccgttattttaataataaaataaaaaatacataacaacatcaaaaaaaaaaaataaaaatcctcacccgcaatctttccaatataccatttcaacccaattcccaaaaaaaacgaccacattcctacaaaaaaaaattcccgaaatccgaaaaaataaacctaccctaaacgaatttcgaaaacccaaaaaacactaaaatatccatataaaaccccaaattcaacaacaaactaaaaaaatcactatcgaaacaaaatacacaaccaaataccctctccccgtacccaaacacaacccaactctctctctaaccaaactaaacgccgttaatactctatttctattctattatcaccctaaaataatcattacaacgtaacgcccttatcctttcaaattcaaacgcaactacaactaaacaacgctataacgcacgcgcaccaccacctacatccgcacctaaccgcgcacgcgccctacataatattcccaacaccgcccttcgaactaccgctcgccacgctaaccgcgaattcgacttccgccgcctcgataataacgaccgcaacaaccgccaaaaccaccaacaaaaactccaacatcgccgatctcaaactaaaaaccaaaaaacacgccgcaaccctaaatctataacgccaacgccaacaccaatatcgcgcctatcccgcgacactcaacctacacgccctccgcgccccgctacttctccgttacccctttaaaacctcgaaaaccgaccctcttcccgcctcactaaccatccctcgtcccctatcgcatcttaaactcgaaaaaccaaactccacgcaaaaccaaaaatctcacgaaacacgcaaactccgtaactcctacccgttttcctactcgaaaacctaaaattaaattttataaaaacgaatttaaaaaaatctaaaaaaaaactaaacaaaaaaatactaaaaccgcgaaatttaactcaccgcaaaactacaacgataaactcttacataaaaaaaaaaatcttattaacaataaaaaaataaacaaacaaaaaaatcgaaaaacaaacgaaaaaaaaaaaaaaaaaaaaaacttatttcttaactactatttaacaaaaactaaaattaaaaaaccaaaaaacaaaaacaaattttaaaattaaaatattttatacatttaaaaatataaaaaaacaacccaaacgattctcgaaaaactaaaaaaaattaccaacttaaatatatatttttaaaaatacgctaaaaaaacaaaacaaaaaaaaaaaatatacttatttaaaaaactaaaataaaaaaaatacgcaactaaaaaattcacaaattttaaaactaacctttttctacgaaattcacgttaacacgaaaaatttaataaaaaaaacgaacctccttttacgttaaatcaaatactttaaatttaaacccaccatatataaaaaaacaaaaaaaaaaaaaatattaaaacgaaaaaaaaaaaaaataatattaacacaaaaaaataccacaaacaataatttctctaaaaaattattataacaaaactatctaaactactaacaataaattccgatttacatattacttatattccattaataatatatctcctcccacccccttatctcccatacactcactccattttcatcttcactataaaaaacaataccaaaaatatctaaaaattaatatatatatatccatatatatatatcatatatttaccatatatatatatatatatatatatatatatatatatatatatttaccctatctttaatcctaaaaaacaaaaaaaaaaaatcaaaaaaaaaaaaaattacactcattatcctaaaaaaacaaaaataaacaaaatatataaaaaaaaaaaaaaaaaaacaaaaccaccaaataaaataataaaaatacaacgcctcgctataccaaacacaataaacgctcaatcaatattaattcccaccattccccttttcttatattccttcttattaatttcctaaaatcctatttaaaaacaataatttatttccccctctctatcccgtcaaattcaccttaaataacacccaactaaatacaaacactaaatttatataaaatatattaatacacacgaacaaaatttattttaactataatatataaactaactttcaacatttacattttatctcacaaaaatatatctattcaaataaccttttttttttatttatttatttcttttttatttttttttttcttttaattatttatttcaattcatataactatttaaactaaaataccttaaactaaaccaatctatatcccaattcgctaacaaacctaaatttataaaattttatttttatttttattttaccttctaatttacaaaaaaaaaaaaaaactcttctaactaaactttaatatacgattaaactttataactatttattctccataaaaacaaaattatttatatttaacatatttttttctaatatattaaattattttaaacaaaaaatattatctcataacgtattatcaatacaaaatatatcgcctccaattctattaaaccttttaaataaataccaaattattaattaaaaacactttacgatcaattaaataaaaatatcgtttcatttaataaaattcgaatcatctttattcctattactattaaaatatccgaaataatctttcccttttaattaatacgtatcactctctcgaatataccaacttaaaaaaacgcttacctctactcttacgtaccgcaatcaaaaaacaataaaaaaaataactctataactatcgttaacgctaaacgcatttccgccgaccccctccattttatccacccaacataaaaacaaaattataccaaattaataaaaaaacaaataaaaaataaaataacataaaataaaataacttccttccccaaaataaactctcgttattcgttttactataattccaatctttatctaaaaacacttttaaaaaaaaaaaaaaaaaaatcctacgaaacgaaatcaacctaaatttaatataacataatcgacaatcaatcccaattcgttaaccctctctaaaacgaaacaaatactaacttcgaaacgaaaaaaaaaccgcaaaaacgaacaaaccaaaacactataaaaaaaaaattccccatctaacactcctatttaaaattaactaaaacaacttcttcattaattaaatttaaaaaataaaaaccaaaatcgaatttaaaaaaaacctaaccttaaaaataataaaaaactctctctccccatatcgtaacccccttctaaaaaaaatcccactaataaaacccaaaaatactacctatataaaaataattaaaaactttaaaaactcgaccctaaccatatccaaaacaaaaactttccttcccgcgcgaactcttataataacgaaaccttccgcaaaaactaaaaaaatcctaaacgtcccctaaaaccccccaccctcgtactaaaaaatacgtaaaacccctaccaaaaccccacatcctccaacaatattccccaccacccccacttaaccctctcccaaatcttaactcgtattcaaaactattcctcaacataaacgtaaacgataaatttctttcttttaactttcaaaaaccactaaacaaaatttaaaccgtattcaatacgcaaaccttacgaatctcctaattaataaacgtcgataatttttaataataaacatctacctacgaacataatacgccctaaaacaaccaaaccatccgccgtaatcctataacctccaacgaactccaatcgacgccgaaaccgaaaatcctaacaaacaaactccaaactccaaaccctaatcctaacccaaatcccaacacgaattcgaaccctaaaaaccctaaaacaaaaaaaataataactccctctcgaaaccaatctaccccaaacaacgaaacgcgaaaaaaacccgaaatcaaaaaaaacgatacgtccaaaccctactaacgaaaacgccgaatatcgatacaaaaactcaataacgcgacgtaaataaatcgaaaatatcccgtacgataaaaaccaaataaattcgacgcgaaaacccgcgaaaatcgaaccgcgacgaaaacgcgataaacgaaaaaacccgcgaaaacaaccaaatccgacgaaaaaaaccaaaatttcttaaccccattcgcaatactccactcgaacacgacctataaaaccaatacatccgaaaaactcgcgacgcccttacctcctcttacgtctactcccccaaaactaacgaaaaacaaaaaccgctttccttaaccctataaaatctcgcccttcgaatccaaactcccgcaaaacctactctcccgaaataccaatatccaaactctaaaacaaacgcctcgatatataaacaaaaattccaaactcgtaattccccgaaccatcccaaaaaaaaatctaaaaaattcactttaaatttaaataaaacccaacatacttataatttaaatcgaaactcaataatcctaatataattaataaaaaacacccccatcctctactccccaaatcttttaaacatacaaaaccttcccgaattacaaaatcaataactaaaaaaaactaaattaaaaaaaattatttaaaacatcattaatattaaaaaccctataatacaaaaaacacaataaaataataaaatcgatacctttacttaaaactaaactaatatacatctattttaaatttttccccaaatttataacttttttaaatcctcaaataataatactttaatataatacaatactcaaatttcgaaactattttaatttctaaaaaatacctctttaacttcaacgacataaaatcctattttttcttcacaaatcaatttacatcataaattacaaacatttacaataaaatctcaaaattatttattttacataacctcaaacacttaactatattaaacaccaatacaaaaaatctataaaatcaatttaatatatataaaaaaattaaaaaatcactcattttcatcacataaacaaaacatttaaaattattttaattatcaatctcccaatttttaatcatacaactaactattaatttaaaaatcattctatataaaaataattactaaaattatatcctactttaattaaatatttctaaacaaaaaaaaataatattatacattaaaaaataaaaaattatttttaatattatattattttaattcaaacgaaaataaaaatctacaaattccaacgaaaaaaaaaaacctaaaataatttcttaatataccattaaaacaattaaccaaaatacattaaaacaatatcacaaacccaaaaataataaatatatcattctaataaaaatattaacttacaaataatttattcaaaataatttttacatttcacataaaatatcttattataacccgcttaattactataatacttattcttcaaaatctaatttatataaacctacaatatacataattcataactcctattaatatacgtatacacaccccaaattttaaatctttacaatatatttaaatatttactaacatattttcaaaataacgaaaataaaaacataaaaaatattaaacatcatattaaaaacaaatacttaccctaccctatacctaaaaacaaaataactaaaaataaaaaaattaaaaaaaattaaataattttcaaactcaaacattaaataaacactaaaatatttcaaacaaaaaaaaatcttatataaaaaatctaaaaatcccaaaaaaaacttacaaatataaatatataacacttctaatacctaaacaattttttttttaatatctaattcataaaacaaaaaatcctcgaatctcgaaatattttattttaaatattttacatatcaatcaaaataaccattacatataccttcgatacaaaaaaatttaatataatacgcgaaattctattaacataaaaaaaaattttaaaatataatcaaatacatcaaataaaaaaaaataaacatacttcttttcttactaaacaactcctcatatatcctaaataaaaatctttataaactcttattcaaacaaaataatatatatttaaaaacacacactataaaactatacttcactactaaattcaaatttcactactactatttaccaatcctctaattttaaacaaattaatctctctatccctcaatttccttatctataaaatataaataaaaataatatctatctcataaaataattaaaaaaattaaataaattaatatttataaaacccttaaaacaataccttacatatatatactaaatactaaataataattacttttattaaaaaaccaataaacattaacctttataataaaaaccttaaaaaaaaaaaacaataaaatattacaaaacaaaaaaaactttctcttataaacaaaaaaaaaacattacctattaatttataattctaactaattacttaacctatataaacctcatctaaaaaatataacaattatcacaatataacaatataattaaaaaatttacctaaaaaaacaatttataaattatatatctctatatacaaaataaataacattattactctaccatacacaattaataaaataaaatttcaaacataacacttatcctcgaaaaacttaccatctaaacaaaacaattcataaatacacataataatactaaaaaacatatactaaatacacttacttaaaaatattaaaacacataatctatacatctaaataaccatataacacatataaacctattaccctaattttaaaaactaaaccttccctaaaaataaataatcttataaaaaaataataaaacgacacccaaaaattaaaaaacgcactttattaaaactaaatatataccatatattatcgtaatttatattccataacaccatctacattttccttaactacccatatttaccgaacattaacaacaaaacgccaaaaaatataaaaactactaaccaaaaatctttaataacaatttaaaaacacatataaaacaaaaaaaaaaatatttaattattactataaaaacctataaaataaacaactaaattacaattacaaaataaattaaaaaaaacttctttctaatatctaaatttaaatatatcactaatattatcccatattttatataatatctataaaaaaccaaatactttttatacatctttatttaaaatatattatcataatatacgactaatttttaaaaacaaatattcttaacttcaaatctttactataccaactattaaatataaaattttaaatcatttcttaacctcctaaaatctataacctcttaatatcctacaacacacaccttaccaattattataaaaatcaaataaaaataaattatataaaatacctaatacataacaaatttcaacaaatatacatctcctttctacttccattatttaccttttaaactactataacataaaaaaaatttttaatttacctttttataattaaaaacaattttaaaaaactttaaaaaataatatacactttaattccaatctcttattataaatattaataatatatatttatattatatacacta

SEQ ID NO: 104 - DNA, 20550 bp, Artificial Sequence
  bisulfite converted genomic DNA
caatacacacaatataaacacacattatcaatacttacaataaaaaattaaaattaaaatacacaccacctcccaaaatttttcaaaactacttctaatcacaaaaaaataaattaaaaatcctctctatattacaataatttaaaaaataaataataaaaataaaaaaaaaatatacatttattaaaacctattatataccaaacaccttacataacttatttttatttaatcctcacaataattaacaaaatatatactacaaaacactaaaaaatcataaattttaaaaaactaaaaaataacctaaaactttacatctaataattaatataacaaaaatttaaaatcaaaaatatctacctctaaaaattaaccgtatactataacaacacatcccaaataaaaatatataaaaaatacttaactcttcataaatattatataaaatataaaacaatattaataatatacctaaatttaaacattaaaaaaaaatccttcttaatttactctataattataactcaattattcatcttacaaatccctataataataattaaacattcctttctttattttatatatattttcaaactactattaaaaatccttaatcaacaacctttatatcttttaacgttttactactaatactcgataaacataaacaaccaaaaaaaatacaaataatactataaaacacaaaccacgacaacatataatatacatttaatcctaacaaaatacgcttcttaacctctaaatatcgcttcaccattcctttataaaactactcatttccaaaaaaaatttaatttccaaaaccaaaacaacaaacccacatatattatataaccattcaaatacacaaattatatatcctaatacctttaaacaaatacatttaacacatacttcctaacactatcatatatatttataaactattttacccaaataataaactcctcgaaaacaaataccatacctaaaatctcaccttattaactatacataacaaaataacaatattatctatcttacatataaaaacacacaacctataaattactcttctaaataaacctcctaactacactactacattataacaattatcacatcttctaaataaaactcacacaaactaaacaattaaccaaaatcacaaactaacaaacaatattttcttcttacccacaaaaaaaaacttttcttatcttacaacactttattatttttttcttttaaaatttttattacaaaaatcaatatctattaaccttttaataaaaataattattatttaatacttaatatacatatacaaaacattattctaaaaattttacaaatattaactcatttaatcctcctaaccattccataaaataaacactatttttatccacattttacaaataaaaaaactaaaaaacaaaaaaattaacttatccaaaatcaaaaaactaataaacaataacaataaaatttaaatccaacaataaaacataactccacaatatatactcttaaacatacactattctacttaaataaaaatctacaaaaatccttactcaaaacatataaaaaattattcaacaaaaaaaaaaacatatttactcctccctatttaatatatttaattatattctaaaacctttcctcataccaataaaactccgcgtattatactaaactttcctacaccgaaaacatatataataattaccttaactaacatataaaatacccaaaacaaaataccccgaaactcgaaaattttttatttcataaattaaacaccaaaaaaaaaattatctaaacatcaaaaatattatacactcacatctataaatctttcttaaaattttcaaatttcttatacaaaatttttttttatctaaaatatttcaatactcactcaatacctaaacttaaaaattatctaatcctttttaattttttcattttcaactactttaccttcaaacataaaacaaaacaaacacttactttcaatataatatttaacactttttatatttttattttcgtcatcttaaaaacatactaataaacatccaaacatactataaaaatttaaaatttaaaatatatatacgtatatcaacaaaaattataaattatatatattacaaacctatataaattaaattttaaaaaacaaacatcacaataatcaaacgaatcataataaaacattccatataaaatataaaaactaccttaaataaattatctataaattaacattctcattaaaataacatatttattatttctaaatttataatattactttaatatattttaactaactattttaataacatattaaaaaaccatttcaaaccttttttccccgttaaaatttacaaacttttatttccgtttaaactaaaataatataatattaaaaacaatcccccacttcccaatatacaataccattttcttctacccaaaaatatttaattaaaacaaaatataacctcaataattatttttacacaaaataactcttaaattaataatcaattatataactaaaaattaaaaaactaacaatcaaaacaatcttaaatactttatttatataataaaaataaataatcctttaattccctcacacacattaaactaatttcacaaattttctatactaatatttaacataatcaaatacttaaaattatataaaataaacaatcttaaaatcttattacaaatatttacaatttataatataaactaatttataaaaaaaaaacaaaatcctatatcgctaaaaccaaaaaaacatttttcaaaaatcaaaataattccgaaatttaaacattacattatactaaaatattaccatctaaaaacccaaaaaaattataaatctaaaaaaaaactcaaaataaatatacatcaattcaactccaaacaaaaacaccgatcttactatcttactatatctcttatatcataaaatccttaacactaataatatcttaaacaatctcttttaactcaatttttcccaatcattaattttacaactcgaaaaaattttacatacccaaaaaatttaaaaaacaaaaaataaaaatatcctttattaattatattaaaattattaaatttcgacccaaactacaaacatattaaaccttatttaaatttaaaataaattcctcaaaccccttcttaaaataattcgaaaaactacgaatttaaaactcttattcacacaccgaaacgcctaccccaaaatttaaacactaacattccgaaaaaacaaaccttacgaaaatctaaacccgaaaaacgaaactccacaaaaccaaaaaaaacgacctctatcctccgttaatcttaaaaaaacaaacgcaaaaaaaaacaaaaacgccgcgaactccccgaatacactaatcccacaaaccgtacccgaataaaacactacgaataaaaccaaaaaattttaacctttctcgccgaacctaactacctccgcgaacctctccgcctaccgcgctcccgccgcgacccgactcccgcgaatctccgcgccgaacccacctaactcctatcgcacgaaacattcccgacccacccacgccgcgtcactaaacctctataccgatacccgacgcctccgccaacaaaacctaaacgcaccgcctcctttaacctcgaacttcccccgcgctccgctacttaaaacaaactaaccccgaaaaaaaaccaccatctcccctactccaaaatctccaaaatccgaacccgtattaaaatctaaattaaaattaaaatttaaaacttaaaacctacctattaaaacccccgaccccgacgccgactaaaactcgctaaaaaccacaaaaccacgacgaataacctaactacttcaaaacgtaccatacccgcaaacaaatatttattattaaaaactaccgacgttcatcaaccaaaaaacccgcaaaacctacgcactaaatacgacccaaatcctattcaataatctttaaaaattaaaaaaaaaaaacctatcgcccacgtctatactaaaaaacaactttaaatacgaactaaaacctaaaaaaaaaccaaataaaaataataaaaaacactactaaaaaatataaaactttaacaaaaattttacgcaccctccaacacgaaaataaaaaatcccaaaaaacgctcaaaactctttcaatctttacgaaaaatcccgtcatcacaaaaacccgcgcgaaaaaaaaaattcctaccttaaacataatcaaaaccgaatcttcaaaatctccaactatccccacacaaacaacacctttaaactttactaataaaatttcttccaaaaaaaaaccacgacataaaaaaaaaaaactcctcattattttcaaaaccaaacttttcctaaacccgattctaacttccaccttctaaatttaaccaataaaaaaactacttcaaccaaccctaaacaaaaatatcaaataaaaaatcctccctccacaataccctaacctacccgcctttacgactcttttcccgctccgaaatcaacacctaccccgctccaaaaaaaatcaacgaactaaaactaattatcgattataccataccaaacccaaattaatttcgctccgcaaaatccctccttccttcctcccaaaaatatccccaaataaaaactaaaattataacaaaacgaataacgaaaatccatcttaaaaaaaaaaattactctatcctatattattttacttcttatctattctttcattaatttaatataaccctatttctatactaaataaataaaataaaaaaaaccgacgaaaatacgctcaacgctaacgacaaccacaaaaccacccttcttactaccccttaactacgacacgtaaaaacaaaaacaaacgcttttccaaattaatatattcgaaaaaataatacgcattaatcaaaaaaaaaaaactatcccgaatattttaataataacaaaaacaaaaataactcgaaccccatcaaataaaacgatattttcattcaattaatcgcaaaatatcttcaattaataacttaacacttatttaaaaaatttaacaaaattaaaaacgacacattttatactaacaacacgtcataaaataacatcttttatttaaaataacttaatacactaaaaaaaaatatatcaaatataaataattttattttcataaaaaacaaataattacaaaactcaaccgcataccaaaattcaattaaaaaaacttttcctctttcttataaattaaaaaataaaacaaaaacaaaaacaaaaccccacaaacttaaacttactaacgaattaaaatacaaactaacttaatccaaaatatcccaatttaaataactacataaattaaaacaaacaaccaaaaaaaaaaaaaaaacaaaaaaaaaacaaacaaacaaaaaaaaaaaattacttaaataaatacacctttataaaataaaatacaaatattaaaaatcaatccacacattataatcaaaataaactttattcgtatatatcaacatatcttacacaaacctaatacctatatctaactaaatattatttaaaataaatttaacgaaataaaaaaaaaaaaataaaccactatcttcaaataaaacttcaaaaaaccaacaaaaaaaaacacaaaaaaaaaaaaataataaaaactaatactaattaaacgcctactatatctaacacaacgaaacgctataccttcattatttcatttaataatcttattttctttttcctttccccacatattctacccacctctatcttcttaaaacaataaatataattttttccctttctaacttttttcttttattccccaaaatcaaaaacaaaacaaatatatatatatatatatatatatatatatatatatatatataacaaatatataatatatatatataaatatatatatatcaatttccaaatacttttaatattatttttcataataaaaataaaaataaaataaatacataaaaaataaaaaaataaaaaaaaacacaccatcaataaaatacaaataacatacaaaccgaaatttactatcaacaatccaaacaattttaccataataatttctcaaaaaaatcattatctataacatttttttatattaatattatttttctctctcctcgttttaatattttctcttttcttactcttccatacataataaatttaaactcaaaacatctaattcaacgtaaaaaaaaacccgcctctctcatcaaatttctcgtattaacgtaaacttcgcaaaaaaaaatcaatttcaaaacctataaacttcccaactacgcacttttttcatcttaattttttaaataaatatacctcttctttctactttaccttcttaacgcatttttaaaaacacacatttaaattaataactccccccaatctctcgaaaatcgtctaaattatttttccatatttttaaatatataaaatactttaattttaaaatttatttttactccttaattctccaatttcaacttctaccaaataacaattaaaaaataaattcccttcctctttttctctcccgtttatctttcgatttttttatttactcattttttcattattaacaaaatttttttttctatacaaaaatccatcgttacaactttacgataaaccaaactccgcgattccaacactcccctatccaatctctctccaaactcccccaaacccgctcctacaaaacccaattctaaaccctcgaataaaaaaacgaacaaaaaccacgaaacctacgtacctcgtaaaatccctaatcctacgtaaaatctaactttccgaatccaaaatacgataaaaaacgaaaaataatcaataaaacgaaaaaaaaaccgactcccgaaatctcaaaaaaataacgaaaaaacaacgaaacgcgaaaaacgtacaaactaaataccgcgaaacaaacgcgacattaatactaacgttaacgtcacaaacccaaaactacgacgtactttttaactttcaatctaaaatcgacgatactaaaattcttactaataatcttaacgactactacgaccgccactaccgaaacgacgaaaaccgaatccgcgaccaacgtaacgaacgacaatccgaaaaacgatactaaaaacatcatataaaacgcgtacgcgaccaaatacgaatacaaataataatacgcgtacgccacaacgctatccaactacaactacgcctaaacctaaaaaaacaaaaacgtcacgttacaataactatcctaaaataacaacaaaataaaaacaaaacattaacgacgtccaacttaaccaaaaaaaaaattaaattatatttaaacacgaaaaaaaaacatttaactatacatcttattccgacaataaccttctcaacctattactaaatctaaaattccacataaatactccaatatcccctaaatctccgaaactcgcttaaaataaacttatttccccgaaccccgaaaacccccttctacaaaaatataaccgtctcccctaaaaactaaactaaaataatatattaaaaaaactacgaataaaaacccttaccctcttctcttaatactaccatacatctcttaccccactaccaaaacaacgaaatatcaacaaacaaactacgcaactttttaatatcattcaaaaaaattactccatcttcaccacaataaacacaattataaatcgatacttctaacctttattaccataacaattacccaaaaatctcgttaaaattcaaattctaattcgcaaaatctaaattaaaacctaaaattctaaatttctaacaatctcccaaacgatattattactactaacccaaaaattaccttttaaataataaaaatctccttttaaaatcacccctccctctttcttcaatcattctctcttatttccaaaaccaaacatcaaaataccaaaatcctataacaccaaaaaaactaaaatctccctaacaccgactctcaattcataatcacacctatctatctccccgatccaaatcactaaaaactaaaaactaattcataacatcacaaacataccaaacaaaaatcctaactaaaaataaaaaaaatcaaacactaattaaaaaaaaatttcgccctcaaacttaaaaaataaaaaattcaaaacactaaaatttcccaaaattaaatcattactacaaactatccttttaaaatatactcttaaaaatttctttataactaaaaaattacaaaaacaaaacaaccctaaaaaaaccaaaacttctctctttaccaaaaataaaactttatttacaaaaacaaatttaaaaacaaaaaaacgaaaaaacaaaaatataaactaaaaatacttatatttatttttcttctatcaaaattatttaatataactaaaaaataaaaaatacctaaaaaaatatctaaaaaattaccttaaaaataccttaaaactaacctctatattaaatttaacaaaatcttaatcaaaaaacttttccttcctctctctctaaaaacaatctttaatatatttttaaaaaaccaattactacccccaaaccccttcaaaaattcccataaaaacaaaaaaaactaaacattcaaacctttaataccgtataaatttttaaaaaataataaatccactatatcatctcaaaataattctccaactatacaaacattaacatctaaactcaaaaacaaataatattcaacaattcaaacaaacattcaaatattttcatatttaaaaacaacttaaaactaaactatacttacctactaaaataacatccttaaaacacctacgttaacataaaatacgactctacaaacttcaaactaactaacgacccctataaaaacacctataaaaaatacaaaaaaaaaataatataaaattaacgtttataacatttttcaaaattccaaaaaatacaaaacaaaacgaattcctttaaaaataaactattatctttctaaactacatccaaaatttaaataaatataacttactcccaaactttaaaactccattaacaacctttaaaaattattaaatcaaaaactattatcatttttaaaattcctttttttctatcattataataataatattcactacttctctctttactcaaactatcaaatattccttatataaaaaacatacctttataaaattaattttcttattttctacatttaactcttcgattttaaaaccaaacctataaattaaaaaaaaaaaaaaaataaaacctaaatattataactaaaaatttttttaaattacaaaaatacaaaaaaaaaaaaatcgtaatttaaacaaaaattaaaaaatacaacaaacaatctttaaattatataaaacaacctcaaattccaaaattaaacatataaattaactacaaaaataaaaaaataaattttataaactttcacaaaataaattactattaatcctaatttcatcttttcacataacaaaatccccataacctaaaactctacttaatacctaataccaacataataataatttaaatatttacccaattaaaacctaaaaaaaatatattcattaataacctataatattaattaacttcatcttaaaaaaaaaccaaacaccaaaacaaataataactcctttacgaaaaaaaaattataaaaattaaaaaaaaataattaatatcataaaaacctcactacaaaaaaatttaaaatttctctattctactatacaacaaaataaaacacaataacaaaataattatacaccattatcataataatctaatttacttctttaaaaaaaaccactatttacaattaaaataataaaaaaacatctaaaaaataactaaaatataaataaaaatataaaacaacaataaaattcacttcttaaaaaaaaaaaaaaaaaacactcaacgaaaaaaaaataaaatatatataaaacaaataactcttaaatactttattctcctaaatattacctacttaaacttaacaacttttacaaacaatataacaaattttttaaaattcaaataaaacttacttttatattccactttcaataataaaacatattaattaactcacaaattaaaatttttaaaaccccattaaaataaaaatactacttcaaaactttcattaatatatttttaaaaacaaatatcataatcaatataaatcttcaaaaatttctctactatttaatacaacaaaaaataaattttataccaaaataacatcctttatataattcacataacctaaaacttcttacctttttttcccctaaaaaaattaaaattaaaatactaataatcataactataataattatcatcatatttttaaaaaattactaaacctctaaaaatctcaatacacaaaacgaaacaaaaaaaacttaaaaaaaaaaactctactactaatactataataaccaaaacaacctattattacttttcctcttcaacgtaactactctatttttttttttcctaatcctattacaaaatataaaaaaaccccttaaaaattatacataattcgctacaaataataatctctatacccaaaaaccgaaaaaatatctattacaacgatactttataacaactacaaatatacgaacctaaaactactccatatattcaaaccaataataactatcattttattctattttattatctaaacgaaaatacaatctaaaacatttaaatttattccccctaaaactaaaaaaatatatatatataaatatacacaatttactcctttaaatacccccaaaacctatttttactattacatttacctccacaaccaataaaaaaaatctatttcaatcctaacttcattaaatataacacgtactaaaaaacaaactttaaaaatataaatactaatatatataatttattttaaaatctaatatatttaaaatcaatttcgttaccttaattaaataaataaacaaaaaataaccaaaatacgtttatttctccgctatttcacacacaatttaaaatcgaccgctaacaacaaactataaatttctacacttaacaattactaattttctttataatctacacatctataaacctaattaaaatatccgcttaacaaacctaaaccctacaaaacaaactttcaaaaaaatccaactccaaaaaacaaaatactctttaaaacttttaaaacatccaaaaataaaacgttttctataaaatttttttttaaaccttataaaaataaacccattaaaattaaaccacattaaaaccaatacgaaacaaaaaaaatataatttataaaaactctaaaaaaaaacccaacacaactttcttcttctaaaaacatatattaaaataaaaaaaaaaaaaaaaaaaaaaatactataaaactaaaatctactttaaaaaataaaacctctaataaaaatatctctttccttctcatcttacaccaaacactaaaaacaccacctcccgaatatatcccccaaacctctttccaaccccaaactctctctactccctaaaccctcgacctcctaacaactaaatacctacactcgaacctccgacaaacccaatcgctaactcaattcctctcgcataaaaacgtcgaaataataaatctcgtcaaaaaacctctccaactcattaaattattccaaaataaaattaatccgacttcgcctctacttaattttaatctaaccttcgtcctccatccctttcgcatcctctttacgatctttcaactccgaaaacactaaaaaaaacaccccaacgaaaccacacgtacatccacacgaacacacacacacacgcacacacacacgaacgaaaacaacacaacaaatcctattaccaaatttatcgcaaaaaaaaataaaaaatccttccccctcgtaaaatcctaatccgacttctcaacccacccgaaaaaaaaatatcccgaaaaaacgcaaaaatcaaatctaaacgaccgcctaaaacaaaataaacaatcatccaccacctccttcacaaacgtacctcgactcaccgcctcactattcaccccccaatcaccgaccttccccaacaaacaccaaataatttccactcactttcgcactcacttactccgcaacactcacaaaaatcaaaaacgcaacgccaaacctctcacaaaacaaaatctaaacataaaaacgcgacaaaaccacccactaacctctcacaccgaccattcccaaaaaactaactcgttctcaaaccaactctcaccaccgctaactctctacctaccgcaaacttactaatctaatttaaaaacaattaaaccgaaaaatatcaacgaaaacaacaaaccccgatattataccgcacaaaaaaccgcatccgcaaacgcccctcgctacccctaaactcgaaccaaaccctacataaaatcccctaaacaaccaaataatctccgtcccgcctacccgaccgaaatcgcacgaacacaaacgcccacgccatattaactacccaaaaaactcgccgcccaaaccgaaccaaaaaacaaaaaacgaaaaaccaacctccgataacgaacgaaaacaaccgctctttctattctctcttcgccctccctcgtaaaaacgcaaactcgaccctaaacgcttaacccacaaaaatcaacaaattcaaacgaaatattcgcgatcctcgatttctattaattactcaaaaccttttcatacaaccaacaactcgaatatttaataaaatataaatttttctactctaaatttacacacatccgttaccactttcctatccttctcctccctttaaaaacaaaaactcttctaatataaacatatacaaccaccatatatatatccccctaaaacctttatcctctacgcccgaatcaaaaactccgaattttaaaaaatcaaaactaaatttaaataatcgaaactatttacaattcttcccaacgcaaaatccaaaccaacataaatattaaaaatcatttccgaaaaaaccgatctacaaaaaaattaatacttaccctaaacttaaaaatcaacaatcccaaaaactacgcccgccgaaaattcaaacctaaacctcgccgtcaaacgcgctaacgaacctataattcgaacctataattataaactcataaccgaaaaactacactaaacaccttaacgataactccaccactttacaaatttaaaaaaacctaatactaatttaaaaaaaaaaaaatcgctaaatctcgaccctaccgaacattctaactacgataatcttaaatattaccgtattttctaattctcaaaattaattttataaacatttatcctttctttaaaaaaaaacattataataaacattataaaccaatttaataacaaaatatttttactaatattatattaaaatttaaatataaaaacacacccttcaaattctaccaataaaataaaaaaactttatctattacatatcatctacacaataaataccactcaaaattttaaaacttcgaaaaaatatccaaatttcaaattaatccataaacttaataaaatctctatttttatccccaaatttccaattactaatctaaacaaaaacaaaccgtatcataaacaacttaattacttacttaaatatataattccacgcataccacatattttcttaattaaaaaaatataacaatacaccaattactacaaacaccaaataccaaatcaattttattattaaactcctttaaattaatataaaacgctctaccattaaaataaaaacgtttcctaacactaaactaacaccaaaaaatttttactctaaaaaaaccgaatactaaataattaaaaacactaaaaaaattatataaatataaatccccacctcccccgccgccccccccccccgcccccaacacaccaaaaaaccgaaacgcctcgcccgaaaaaaacaacgtaacctaaacctcaactttcgttaacttccttctaccttaaaaaaaaataaaaaattttaacccctaaaatccaaaaattcaaaaactctacgaaattcgaaaaatcttaacgaccccaaacacctaaacgaccgaaaaattaaactttccacctctaccccttctccctcccgacaaactctacgctaaaaactaactttaatcccgccgtctaattcaacaccccctcctacaacccgaccccgcgaacttccacgtccgcctacgaaccatccgaactacgaacccatcctcccgctaataaaaaatacatttcgataaaataaaaacatctaaaaaaaacgcgcacaaaccccacacgcttccccccacgccacccccacaacacactaaaaccccacccataaccgaacataccaccgaacccccacccttccactatcactctaactaacaaaactaaaatccaaaaccctctccgtatccctctcccctccccgctaaacctcgaaatcctctcccgcccgaaaaaaatccgaaaaacgaaaaaaaaaaccgctaccgaaaatcaatcaaatcgttaccctccgtcaatcgcgaactacccgactccctacttctctcgacgacgcccatatccaactcccgaacgaaaaaacgccctcctccaactcctccgcctactcctcctcctcctacacctcctccgcctcctccgccgccgcctccgcctcctccgccgccgcctccgccgaccgcccgaactaccgaactactacgatcgtcgcgacccgcctcgatacaaccgatcgactccttaaccccgcgcaacgacccgctctccaacacctcccgatacgtaatcgcctccttcttctccttcactttctaatcaaaaaacttaaaaacgaacgccgtaaattcttccatcgccgccgcacgtcaacccgacgctcaacctctaccaacaaaaccccgctctttttttccttcttctttttttactactccaacccccccaataataacacatcaataaaacaaaaaataaaaaaaaaaaaaaaaaaaaaaaaaaaaaaaaaaaaaaaaaaaaaaaaaaaaaaaaaaaaaaaaaaaataaaaaaaaaaaaaaaaataaaaaaaaaaaaaaaaaaaaaaaaaaaaaaaaaaaaaaaaaaataaaaaaaaaaaaaaaaaaaaaaaaaaaaaaaaaaaaaacgaaaactaccgaaaaaaaataaaaactaatacttccctaccgaaacgcgcttattcaatattaaaatctttaacaattcttcctacgaaaaattcaaatctaataacgacgctacgcttaaaatcccactatttatacttcctaacgacgacctcttattttaaataaattacctcccctcgcaactcgaaataaacccccttcccgaataacaatcgcgcctctaccgaaaattaaaaaaaaaaaaaaaaaaaaaacaaaaaaaaaaaaaaaaaaaaaaaaaaaaaaaaaaaaaaaaaaaaaaaaaaaaaaaaaaaaaaaaattaaaattcgaacgaactaaaactaaaataataaaacaacacaaaaaaaccgaaaaaaacgaaaaaaaaaaaccgatccccgaccgctcaaattttcaaataacccctaccgcctatactcttaaccattaatccaaaattaacaaaaatccctaattaatttaattaaacgtaaattttacgttaatatcacgacttaattaaacactaaaaaactaaataaaccccgcgaaataaaaccaaaaaaaaactaacaaatacgcaactcttaaaatcaatcaaatatcccgacactacatccttccctacaaccttacttcgaatcaaaatacctcgcaatactcaacttcgcattacttttcctcgtccctaccctacatcaaccgcccaacaatttacaaaccccgcatcccattcccgcatcctaaccccgcatcccaattctacatccccgcctctccctcacaatcccacccctaccgaccgtaactccaccgcccaacatcatcctacccaaaaacaaaattacctacaccttctccgacccgcgcaacttctcttaaaaacttcccgactcgcaaacaaactaaatccgaatcttctccaaactcctcgcccctcgatccgtattattcgctctattattcgtatcctaaaacccaactaactcctctataaacaaaccccgctaaaaaaaaccaatcgatttaacaaatttccccaacaactattaactaacaaatctcattttaaaatatttccttaacgcccgatcaaaaacaactcgacttcgttcgtttcctctctaaaatctcaaaactcccacccttctcccttactctctacactcgaacccctctataataaattacaaaacttcttctttaacatcttaaaaaacatccgaatttatttactaatttaaaaaacaaaaaattatccctcttcgaatctaaaaaaaaaatcgacgttaaatttataccccctctaatttcatttattacgaaaaactaaaaaaaaaacgctcgccaaaaataaaaatctctctacctaccccccccaccaccccgcttacgatttaaaattctatttctaaactattttcatcgaaacgatttattacgttaaaaaaacatctatattcctaaatcatttatctatattataccgaacaaaacttactataaaaaatataactatacaaatacatactcacaaaaaaatatttacatataatattatatttaaatatataaacaaatatacctctaaatataacttaaaaaacattttcaaatactctaaatattaatacaaactttctaaaaattaaaaataacttaatcattattttaaatctaatactcttaataaaaataaaaaaaattacaaaacattaatatatatatcttccgtatattaattaaaacatcaaaacaaattaacaaataatttaaaaaattccgtcaaaacaacctaaaacacttacaaaaaaaaaacacaattataacttaatatattaatatttctcaaataaatataaataaaaactaaatataaccttatattatactacaatactcacattaaaatattcatatttaataaatttaaaaattatatatatcatactttttaaaaacgttattttccctttttaaaacatttcattttttaccacttttaaaaaaactaatatctataatttttccgcaactataacttttaaatataaatacattattatcaatacttacttttattttattacaccacaaaaaaaacaaaatttcaaaattatacgaatttaaaaacaatttcacattaaatcttaaattactctttataactactttctaatattatcaaaaaaaaataatcatacaactttaatcctttataaaaatctatttttaaaattatttaacaaaaaaaccaataataaaaaaaactaaaaaaatacgatactcaaaatactctcaaactaaaatattaaatacatattcacaaataactcaaaaataaccactattaaaaatcgattaaaaaatcaaaaaacccaccaactacttatttacctttttaaatacataacttttaaatttaaaatcatatttcatctactaaacttaaaaaaaaaataaccactttaaaaataatcaaaaaaatcacaaacacaactattatataattcaaaccaataaattttcccataatctcaactttttaactcattacatatttaaaaataataatattaataacaaataaaaccataaaaaatctttaatatctaaccacaaatttccactaacctaaaaaaaattactttaaaaaatatttcaaaattttaaattcatacattaataaatactcacaaaattccaataatattatttcattaaacaacaaatatcttccaaaaacaaaacatttcaaaatacaatttttatttaaaaaaaaaaaaaaacatttataataaaactcaactaacaatctataaacaaatacacaaattccaataaaattcaaaaccccaaaaatttccccaactcttaaattatttaaaatatacacgtaatattataataattaaattttaaaacgatacctcaaaactaactaattaaaatacattatttacgaaaaatatattataaaaataatttttcaccatctcaaatatctacgaaaaactataacttaattatctaacaataataaataaattaattctcataatcgaccaaaacccaaaccaacaatttatttatctttttaactttacttaaaaataaataaaaaaaaaatttccatataaaaaaaaataaataatataatataaattacaaaaaatactaaatctctttaatttctattaatttaaataaaaaaactccacacacctataaatttaaattctctttcaaaaaaaaccgctccccgcctcgcctcaaacaactctctcctattcctctactaaccaattactttaatctaaaaaactaatttacactcaacttataaataccttcaccttcaaaacaaaaaaaacaccgacttttaatacatttttacaaataaatcattacaatttaatcacacacgactctatacaaacacactcccataatttattatcgttaaacgaatttccccctcccccaacgtaaaataaccaattttatttcgaataaatatcataaacaaaacttcctacgatacaaatttatttactaattacccataacgataacgacgactactaaaacaataacactctccaatcccacctttattacttttaataacaataaaatcaaaataaacaaacacgcaaaacaaacgccaaacaaaaaatcgaccgcgttacaatctactccctcgacattcccaacgcctaacaacgtccatcgatacactcgatatctcgactaaaactacctaacgctaaaaccaaaaaaacgctaaacttaaactaaaacaaattcgataaacgccgacgacgccctaatctaaaaaaacgactcaaaaactacgacgcttacacgtcaacgaaaaatataaacccaaaaatctaaacccaaataatacccacgaccaaaacctaaaaaacgacaaccgtaactacgaaactccgaaaccctaatccgacgaaaaacgacgcgaaacctaacgcaatttacgactcaatatctataaaaaataaactacgacctcgaaacgtacgcaatatcaccgtacgcatacgtcccgcacctaaaaaactccgaactccttaaatcaaaactaataactataaaataaataaataaccgcaaacctcaaacttaaccttctatcttaaaaacatatcgaaaaattcgccgactcctcccctcgccccacgttcctaattcttcataactacttttaaatttcctaactcatcttacaatataaacctaacgcttcctcactaactctaaataaaataaaacaaaaaaaaaactaaattctaataccctctatcccatccactccactatccctaccttaaatccaactctctttctaattccgccctaccctttctaactcacactaacttactaaaaaaaataatacaaaataaaataaatattcctctcttaaaatataaatatactcgccttaaacacactatatattcctttaacttctatactaataacatataaccaaaaacatataactctatttacttttacaaaatattacaatacaccgtaaaacatattacctactcttaattttaaattaaccttaacgtaatttctctctcaaaaattatatatctttaaatacacactaaaaacctaaacaaaaaaatatttttttacactttcaaaattaacaataacccaattatattccaactaactaaataataaataaataaattcaaatatcttatattatcacaaaaaaacattcgaattatcatctttaaacttaaatatattataaaaattctaaataaaaaaaataaacaaaattcccaaatttaaaatttaaaacaaatataacaattacaaccttaaaaaaaactaaatatcctttaaaaacctctctaatcttaaaatttataaatattcactttctttacaaacaaaaatttcatactaaataatataacactttatatttttcaataaaaaaactaaaaatatcaaaatctaaaacgacaaaaacaactaacaccttctattaattaaccttaccaactcaaccaatctcacaaaaaaaaatattataaattaaaaaaattctaaaaacgaattatttataataaatctataattatatttcctactttcatattcaaaccattaaaaataaattccta

SEQ ID NO: 105 - DNA, 20550 bp, Artificial Sequence
  bisulfite converted genomic DNA
taggaatttatttttaatggtttgaatatgaaagtaggaaatataattatagatttattataaataattcgtttttagaatttttttaatttataatatttttttttgtgagattggttgagttggtaaggttaattaatagaaggtgttagttgtttttgtcgttttagattttgatatttttagtttttttattgaaaaatataaagtgttatattatttagtatgaaatttttgtttgtaaagaaagtgaatatttataaattttaagattagagaggtttttaaaggatatttagttttttttaaggttgtaattgttatatttgttttaaattttaaatttgggaattttgtttattttttttatttagaatttttataatatatttaagtttaaagatgataattcgaatgtttttttgtgataatataagatatttgaatttatttatttattatttagttagttggaatataattgggttattgttaattttgaaagtgtaaaaaaatatttttttgtttaggtttttagtgtgtatttaaagatatataatttttgagagagaaattacgttaaggttaatttaaaattaagagtaggtaatatgttttacggtgtattgtaatattttgtaaaagtaaatagagttatatgtttttggttatatgttattagtatagaagttaaaggaatatatagtgtgtttaaggcgagtatatttatattttaagagaggaatatttattttattttgtattattttttttagtaagttagtgtgagttagaaagggtagggcggaattagaaagagagttggatttaaggtagggatagtggagtggatgggatagagggtattagaatttagttttttttttgttttattttatttagagttagtgaggaagcgttaggtttatattgtaagatgagttaggaaatttaaaagtagttatgaagaattaggaacgtggggcgaggggaggagtcggcgaatttttcgatatgtttttaagatagaaggttaagtttgaggtttgcggttatttatttattttatagttattagttttgatttaaggagttcggagttttttaggtgcgggacgtatgcgtacggtgatattgcgtacgtttcgaggtcgtagtttattttttatagatattgagtcgtaaattgcgttaggtttcgcgtcgtttttcgtcggattagggtttcggagtttcgtagttacggttgtcgttttttaggttttggtcgtgggtattatttgggtttagatttttgggtttatatttttcgttgacgtgtaagcgtcgtagtttttgagtcgtttttttagattagggcgtcgtcggcgtttatcgaatttgttttagtttaagtttagcgtttttttggttttagcgttaggtagttttagtcgagatatcgagtgtatcgatggacgttgttaggcgttgggaatgtcgagggagtagattgtaacgcggtcgattttttgtttggcgtttgttttgcgtgtttgtttattttgattttattgttattaaaagtaataaaggtgggattggagagtgttattgttttagtagtcgtcgttatcgttatgggtaattagtaaataaatttgtatcgtaggaagttttgtttatgatatttattcgaaataaaattggttattttacgttgggggagggggaaattcgtttaacgataataaattatgggagtgtgtttgtatagagtcgtgtgtgattaaattgtaatgatttatttgtaaaaatgtattaaaagtcggtgttttttttgttttgaaggtgaaggtatttataagttgagtgtaaattagttttttagattaaagtaattggttagtagaggaataggagagagttgtttgaggcgaggcggggagcggttttttttgaaagagaatttaaatttataggtgtgtggagtttttttatttaaattaatagaaattaaagagatttagtattttttgtaatttatattatattatttatttttttttatatggaaattttttttttatttatttttaagtaaagttaaaaagataaataaattgttggtttgggttttggtcgattatgagaattaatttatttattattgttagataattaagttatagtttttcgtagatatttgagatggtgaaaaattatttttataatatatttttcgtaaataatgtattttaattagttagttttgaggtatcgttttaaaatttaattattataatattacgtgtatattttaaataatttaagagttggggaaatttttggggttttgaattttattggaatttgtgtatttgtttatagattgttagttgagttttattataaatgtttttttttttttttaaataaaaattgtattttgaaatgttttgtttttggaagatatttgttgtttaatgaaataatattattggaattttgtgagtatttattaatgtatgaatttaaaattttgaaatattttttaaagtaattttttttaggttagtggaaatttgtggttagatattaaagattttttatggttttatttgttattaatattattatttttaaatatgtaatgagttaaaaagttgagattatgggaaaatttattggtttgaattatataatagttgtgtttgtgatttttttgattatttttaaagtggttattttttttttaagtttagtagatgaaatatgattttaaatttaaaagttatgtatttaaaaaggtaaataagtagttggtgggttttttgattttttaatcgatttttaatagtggttatttttgagttatttgtgaatatgtatttaatattttagtttgagagtattttgagtatcgtatttttttagttttttttattattggtttttttgttaaataattttaaaaatagatttttataaaggattaaagttgtatgattatttttttttgataatattagaaagtagttataaagagtaatttaagatttaatgtgaaattgtttttaaattcgtataattttgaaattttgttttttttgtggtgtaataaaataaaagtaagtattgataataatgtatttatatttaaaagttatagttgcggaaaaattatagatattagtttttttaaaagtggtaaaaaatgaaatgttttaaaaagggaaaataacgtttttaaaaagtatgatatatataatttttaaatttattaaatatgaatattttaatgtgagtattgtagtataatataaggttatatttagtttttatttatatttatttgagaaatattaatatattaagttataattgtgttttttttttgtaagtgttttaggttgttttgacggaattttttaaattatttgttaatttgttttgatgttttaattaatatacggaagatatatatattaatgttttgtaattttttttatttttattaagagtattagatttaaaataatgattaagttatttttaatttttagaaagtttgtattaatatttagagtatttgaaaatgttttttaagttatatttagaggtatatttgtttatatatttaaatataatattatatgtaaatatttttttgtgagtatgtatttgtatagttatattttttatagtaagttttgttcggtataatatagataaatgatttaggaatatagatgtttttttaacgtaataaatcgtttcgatgaaaatagtttagaaatagaattttaaatcgtaagcggggtggtggggggggtaggtagagagatttttatttttggcgagcgttttttttttagtttttcgtaataaatgaaattagagggggtataaatttaacgtcgattttttttttagattcgaagagggataattttttgttttttaaattagtaaataaattcggatgttttttaagatgttaaagaagaagttttgtaatttattatagaggggttcgagtgtagagagtaagggagaagggtgggagttttgagattttagagaggaaacgaacgaagtcgagttgtttttgatcgggcgttaaggaaatattttaaaatgagatttgttagttaatagttgttggggaaatttgttaaatcgattggttttttttagcggggtttgtttatagaggagttagttgggttttaggatacgaataatagagcgaataatacggatcgaggggcgaggagtttggagaagattcggatttagtttgtttgcgagtcgggaagtttttaagagaagttgcgcgggtcggagaaggtgtaggtaattttgtttttgggtaggatgatgttgggcggtggagttacggtcggtaggggtgggattgtgagggagaggcggggatgtagaattgggatgcggggttaggatgcgggaatgggatgcggggtttgtaaattgttgggcggttgatgtagggtagggacgaggaaaagtaatgcgaagttgagtattgcgaggtattttgattcgaagtaaggttgtagggaaggatgtagtgtcgggatatttgattgattttaagagttgcgtatttgttagtttttttttggttttatttcgcggggtttatttagttttttagtgtttaattaagtcgtgatattaacgtaaaatttacgtttaattaaattaattagggatttttgttaattttggattaatggttaagagtataggcggtaggggttatttgaaaatttgagcggtcggggatcggtttttttttttcgtttttttcggtttttttgtgttgttttattattttagttttagttcgttcgaattttaatttttttttttttttttttttttttttttttttttttttttttttttttttttttttttttttttgttttttttttttttttttttttaattttcggtagaggcgcgattgttattcgggaagggggtttatttcgagttgcgaggggaggtaatttatttaaaataagaggtcgtcgttaggaagtataaatagtgggattttaagcgtagcgtcgttattagatttgaatttttcgtaggaagaattgttaaagattttaatattgaataagcgcgtttcggtagggaagtattagtttttattttttttcggtagttttcgttttttttttttttttttttttttttttttttttttttatttttttttttttttttttttttttttttttttttttttttttatttttttttttttttttattttttttttttttttttttttttttttttttttttttttttttttttttttttttttttttttttttattttttgttttattgatgtgttattattgggggggttggagtagtaaaaaaagaagaaggaaaaaaagagcggggttttgttggtagaggttgagcgtcgggttgacgtgcggcggcgatggaagaatttacggcgttcgtttttaagttttttgattagaaagtgaaggagaagaaggaggcgattacgtatcgggaggtgttggagagcgggtcgttgcgcggggttaaggagtcgatcggttgtatcgaggcgggtcgcgacgatcgtagtagttcggtagttcgggcggtcggcggaggcggcggcggaggaggcggaggcggcggcggaggaggcggaggaggtgtaggaggaggaggagtaggcggaggagttggaggagggcgttttttcgttcgggagttggatatgggcgtcgtcgagagaagtagggagtcgggtagttcgcgattgacggagggtaacgatttgattgattttcggtagcggttttttttttcgtttttcggatttttttcgggcgggagaggatttcgaggtttagcggggaggggagagggatacggagagggttttggattttagttttgttagttagagtgatagtggaagggtgggggttcggtggtatgttcggttatgggtggggttttagtgtgttgtgggggtggcgtggggggaagcgtgtggggtttgtgcgcgttttttttagatgtttttattttatcgaaatgtattttttattagcgggaggatgggttcgtagttcggatggttcgtaggcggacgtggaagttcgcggggtcgggttgtaggagggggtgttgaattagacggcgggattaaagttagtttttagcgtagagtttgtcgggagggagaaggggtagaggtggaaagtttaatttttcggtcgtttaggtgtttggggtcgttaagatttttcgaatttcgtagagtttttgaatttttggattttaggggttaaaattttttatttttttttaaggtagaaggaagttaacgaaagttgaggtttaggttacgttgtttttttcgggcgaggcgtttcggttttttggtgtgttgggggcggggggggggggcggcgggggaggtggggatttatatttatataatttttttagtgtttttaattatttagtattcggtttttttagagtaaaaattttttggtgttagtttagtgttaggaaacgtttttattttaatggtagagcgttttatattaatttaaaggagtttaataataaaattgatttggtatttggtgtttgtagtaattggtgtattgttatatttttttaattaagaaaatatgtggtatgcgtggaattatatatttaagtaagtaattaagttgtttatgatacggtttgtttttgtttagattagtaattggaaatttggggataaaaatagagattttattaagtttatggattaatttgaaatttggatattttttcgaagttttaaaattttgagtggtatttattgtgtagatgatatgtaatagataaagtttttttattttattggtagaatttgaagggtgtgtttttatatttaaattttaatataatattagtaaaaatattttgttattaaattggtttataatgtttattataatgtttttttttaaagaaaggataaatgtttataaaattaattttgagaattagaaaatacggtaatatttaagattatcgtagttagaatgttcggtagggtcgagatttagcgatttttttttttttaaattagtattaggtttttttaaatttgtaaagtggtggagttatcgttaaggtgtttagtgtagtttttcggttatgagtttataattataggttcgaattataggttcgttagcgcgtttgacggcgaggtttaggtttgaattttcggcgggcgtagtttttgggattgttgatttttaagtttagggtaagtattaatttttttgtagatcggttttttcggaaatgatttttaatatttatgttggtttggattttgcgttgggaagaattgtaaatagtttcgattatttaaatttagttttgattttttaaaattcggagtttttgattcgggcgtagaggataaaggttttagggggatatatatatggtggttgtatatgtttatattagaagagtttttgtttttaaagggaggagaaggataggaaagtggtaacggatgtgtgtaaatttagagtagaaaaatttatattttattaaatattcgagttgttggttgtatgaaaaggttttgagtaattaatagaaatcgaggatcgcgaatatttcgtttgaatttgttgatttttgtgggttaagcgtttagggtcgagtttgcgtttttacgagggagggcgaagagagaatagaaagagcggttgttttcgttcgttatcggaggttggtttttcgttttttgttttttggttcggtttgggcggcgagttttttgggtagttaatatggcgtgggcgtttgtgttcgtgcgatttcggtcgggtaggcgggacggagattatttggttgtttaggggattttatgtagggtttggttcgagtttaggggtagcgaggggcgtttgcggatgcggttttttgtgcggtataatatcggggtttgttgttttcgttgatatttttcggtttaattgtttttaaattagattagtaagtttgcggtaggtagagagttagcggtggtgagagttggtttgagaacgagttagttttttgggaatggtcggtgtgagaggttagtgggtggttttgtcgcgtttttatgtttagattttgttttgtgagaggtttggcgttgcgtttttgatttttgtgagtgttgcggagtaagtgagtgcgaaagtgagtggaaattatttggtgtttgttggggaaggtcggtgattggggggtgaatagtgaggcggtgagtcgaggtacgtttgtgaaggaggtggtggatgattgtttattttgttttaggcggtcgtttagatttgatttttgcgttttttcgggatatttttttttcgggtgggttgagaagtcggattaggattttacgagggggaaggattttttatttttttttgcgataaatttggtaataggatttgttgtgttgttttcgttcgtgtgtgtgtgcgtgtgtgtgtgtgttcgtgtggatgtacgtgtggtttcgttggggtgttttttttagtgttttcggagttgaaagatcgtaaagaggatgcgaaagggatggaggacgaaggttagattaaaattaagtagaggcgaagtcggattaattttattttggaataatttaatgagttggagaggttttttgacgagatttattatttcgacgtttttatgcgagaggaattgagttagcgattgggtttgtcggaggttcgagtgtaggtatttagttgttaggaggtcgagggtttagggagtagagagagtttggggttggaaagaggtttgggggatatattcgggaggtggtgtttttagtgtttggtgtaagatgagaaggaaagagatatttttattagaggttttattttttaaagtagattttagttttatagtatttttttttttttttttttttttattttaatatatgtttttagaagaagaaagttgtgttgggtttttttttagagtttttataaattatattttttttgtttcgtattggttttaatgtggtttaattttaatgggtttatttttataaggtttaaaaaaaaattttatagaaaacgttttatttttggatgttttaaaagttttaaagagtattttgttttttggagttggatttttttgaaagtttgttttgtagggtttaggtttgttaagcggatattttaattaggtttatagatgtgtagattataaagaaaattagtaattgttaagtgtagaaatttatagtttgttgttagcggtcgattttaaattgtgtgtgaaatagcggagaaataaacgtattttggttattttttgtttatttatttaattaaggtaacgaaattgattttaaatatattagattttaaaataaattatatatattagtatttatatttttaaagtttgttttttagtacgtgttatatttaatgaagttaggattgaaatagattttttttattggttgtggaggtaaatgtaatagtaaaaataggttttgggggtatttaaaggagtaaattgtgtatatttatatatatatatttttttagttttagggggaataaatttaaatgttttagattgtattttcgtttagataataaaatagaataaaatgatagttattattggtttgaatatatggagtagttttaggttcgtatatttgtagttgttataaagtatcgttgtaatagatattttttcggtttttgggtatagagattattatttgtagcgaattatgtataatttttaaggggtttttttatattttgtaataggattaggaaaaaaaaaaatagagtagttacgttgaagaggaaaagtaataataggttgttttggttattatagtattagtagtagagtttttttttttaagttttttttgtttcgttttgtgtattgagatttttagaggtttagtaattttttaaaaatatgatgataattattatagttatgattattagtattttaattttaatttttttaggggaaaaaaaggtaagaagttttaggttatgtgaattatataaaggatgttattttggtataaaatttattttttgttgtattaaatagtagagaaatttttgaagatttatattgattatgatatttgtttttaaaaatatattaatgaaagttttgaagtagtatttttattttaatggggttttaaaaattttaatttgtgagttaattaatatgttttattattgaaagtggaatataaaagtaagttttatttgaattttaaaaaatttgttatattgtttgtaaaagttgttaagtttaagtaggtaatatttaggagaataaagtatttaagagttatttgttttatatatattttatttttttttcgttgagtgttttttttttttttttttaagaagtgaattttattgttgttttatatttttatttatattttagttattttttagatgtttttttattattttaattgtaaatagtggttttttttaaagaagtaaattagattattatgataatggtgtataattattttgttattgtgttttattttgttgtatagtagaatagagaaattttaaatttttttgtagtgaggtttttatgatattaattatttttttttaatttttataatttttttttcgtaaaggagttattatttgttttggtgtttggtttttttttaagatgaagttaattaatattataggttattaatgaatatattttttttaggttttaattgggtaaatatttaaattattattatgttggtattaggtattaagtagagttttaggttatggggattttgttatgtgaaaagatgaaattaggattaatagtaatttattttgtgaaagtttataaaatttatttttttatttttgtagttaatttatatgtttaattttggaatttgaggttgttttatataatttaaagattgtttgttgtattttttaatttttgtttaaattacgatttttttttttttgtatttttgtaatttaaaaaaatttttagttataatatttaggttttattttttttttttttttaatttataggtttggttttaaaatcgaagagttaaatgtagaaaataagaaaattaattttataaaggtatgttttttatataaggaatatttgatagtttgagtaaagagagaagtagtgaatattattattataatgatagaaaaaaaggaattttaaaaatgataatagtttttgatttaataatttttaaaggttgttaatggagttttaaagtttgggagtaagttatatttatttaaattttggatgtagtttagaaagataatagtttatttttaaaggaattcgttttgttttgtattttttggaattttgaaaaatgttataaacgttaattttatattattttttttttgtattttttataggtgtttttataggggtcgttagttagtttgaagtttgtagagtcgtattttatgttaacgtaggtgttttaaggatgttattttagtaggtaagtatagtttagttttaagttgtttttaaatatgaaaatatttgaatgtttgtttgaattgttgaatattatttgtttttgagtttagatgttaatgtttgtatagttggagaattattttgagatgatatagtggatttattattttttaaaaatttatacggtattaaaggtttgaatgtttagttttttttgtttttatgggaatttttgaaggggtttgggggtagtaattggttttttaaaaatatattaaagattgtttttagagagagaggaaggaaaagttttttgattaagattttgttaaatttaatatagaggttagttttaaggtatttttaaggtaattttttagatatttttttaggtattttttattttttagttatattaaataattttgatagaagaaaaataaatataagtatttttagtttatatttttgttttttcgtttttttgtttttaaatttgtttttgtaaataaagttttatttttggtaaagagagaagttttggtttttttagggttgttttgtttttgtaattttttagttataaagaaatttttaagagtatattttaaaaggatagtttgtagtaatgatttaattttgggaaattttagtgttttgaattttttattttttaagtttgagggcgaaatttttttttaattagtgtttgattttttttatttttagttaggatttttgtttggtatgtttgtgatgttatgaattagtttttagtttttagtgatttggatcggggagatagataggtgtgattatgaattgagagtcggtgttagggagattttagtttttttggtgttataggattttggtattttgatgtttggttttggaaataagagagaatgattgaagaaagagggaggggtgattttaaaaggagatttttattatttaaaaggtaatttttgggttagtagtaataatatcgtttgggagattgttagaaatttagaattttaggttttaatttagattttgcgaattagaatttgaattttaacgagatttttgggtaattgttatggtaataaaggttagaagtatcgatttataattgtgtttattgtggtgaagatggagtaatttttttgaatgatattaaaaagttgcgtagtttgtttgttgatatttcgttgttttggtagtggggtaagagatgtatggtagtattaagagaagagggtaagggtttttattcgtagtttttttaatatattattttagtttagtttttaggggagacggttatatttttgtagaagggggttttcggggttcggggaaataagtttattttaagcgagtttcggagatttaggggatattggagtatttatgtggaattttagatttagtaataggttgagaaggttattgtcggaataagatgtatagttaaatgtttttttttcgtgtttaaatataatttaattttttttttggttaagttggacgtcgttaatgttttgtttttattttgttgttattttaggatagttattgtaacgtgacgtttttgtttttttaggtttaggcgtagttgtagttggatagcgttgtggcgtacgcgtattattatttgtattcgtatttggtcgcgtacgcgttttatatgatgtttttagtatcgtttttcggattgtcgttcgttacgttggtcgcggattcggttttcgtcgtttcggtagtggcggtcgtagtagtcgttaagattattagtaagaattttagtatcgtcgattttagattgaaagttaaaaagtacgtcgtagttttgggtttgtgacgttaacgttagtattaatgtcgcgtttgtttcgcggtatttagtttgtacgtttttcgcgtttcgttgttttttcgttatttttttgagatttcgggagtcggtttttttttcgttttattgattatttttcgttttttatcgtattttggattcggaaagttagattttacgtaggattagggattttacgaggtacgtaggtttcgtggtttttgttcgtttttttattcgagggtttagaattgggttttgtaggagcgggtttgggggagtttggagagagattggataggggagtgttggaatcgcggagtttggtttatcgtaaagttgtaacgatggatttttgtatagaaaaaaaaattttgttaataatgaaaaaatgagtaaataaaaaaatcgaaagataaacgggagagaaaaagaggaagggaatttattttttaattgttatttggtagaagttgaaattggagaattaaggagtaaaaataaattttaaaattaaagtattttatatatttaaaaatatggaaaaataatttagacgattttcgagagattggggggagttattaatttaaatgtgtgtttttaaaaatgcgttaagaaggtaaagtagaaagaagaggtatatttatttaaaaaattaagatgaaaaaagtgcgtagttgggaagtttataggttttgaaattgatttttttttgcgaagtttacgttaatacgagaaatttgatgagagaggcgggtttttttttacgttgaattagatgttttgagtttaaatttattatgtatggaagagtaagaaaagagaaaatattaaaacgaggagagagaaaaataatattaatataaaaaaatgttatagataatgatttttttgagaaattattatggtaaaattgtttggattgttgatagtaaatttcggtttgtatgttatttgtattttattgatggtgtgtttttttttatttttttattttttatgtatttattttatttttatttttattatgaaaaataatattaaaagtatttggaaattgatatatatatatttatatatatatattatatatttgttatatatatatatatatatatatatatatatatatatatatatttgttttgtttttgattttggggaataaaagaaaaaagttagaaagggaaaaaattatatttattgttttaagaagatagaggtgggtagaatatgtggggaaaggaaaaagaaaataagattattaaatgaaataatgaaggtatagcgtttcgttgtgttagatatagtaggcgtttaattagtattagtttttattatttttttttttttgtgtttttttttgttggttttttgaagttttatttgaagatagtggtttatttttttttttttatttcgttaaatttattttaaataatatttagttagatataggtattaggtttgtgtaagatatgttgatatatacgaataaagtttattttgattataatgtgtggattgatttttaatatttgtattttattttataaaggtgtatttatttaagtaattttttttttttgtttgtttgttttttttttgttttttttttttttttggttgtttgttttaatttatgtagttatttaaattgggatattttggattaagttagtttgtattttaattcgttagtaagtttaagtttgtggggttttgtttttgtttttgttttattttttaatttataagaaagaggaaaagtttttttaattgaattttggtatgcggttgagttttgtaattatttgttttttatgaaaataaaattatttatatttgatatatttttttttagtgtattaagttattttaaataaaagatgttattttatgacgtgttgttagtataaaatgtgtcgtttttaattttgttaaattttttaaataagtgttaagttattaattgaagatattttgcgattaattgaatgaaaatatcgttttatttgatggggttcgagttatttttgtttttgttattattaaaatattcgggatagttttttttttttgattaatgcgtattattttttcgaatatattaatttggaaaagcgtttgtttttgtttttacgtgtcgtagttaaggggtagtaagaagggtggttttgtggttgtcgttagcgttgagcgtattttcgtcggttttttttattttatttatttagtatagaaatagggttatattaaattaatgaaagaatagataagaagtaaaataatataggatagagtaatttttttttttaagatggattttcgttattcgttttgttataattttagtttttatttggggatatttttgggaggaaggaaggagggattttgcggagcgaaattaatttgggtttggtatggtataatcgataattagttttagttcgttgattttttttggagcggggtaggtgttgatttcggagcgggaaaagagtcgtaaaggcgggtaggttagggtattgtggagggaggattttttatttgatatttttgtttagggttggttgaagtagtttttttattggttaaatttagaaggtggaagttagaatcgggtttaggaaaagtttggttttgaaaataatgaggagttttttttttttatgtcgtggtttttttttggaagaaattttattagtaaagtttaaaggtgttgtttgtgtggggatagttggagattttgaagattcggttttgattatgtttaaggtaggaattttttttttcgcgcgggtttttgtgatgacgggatttttcgtaaagattgaaagagttttgagcgttttttgggattttttattttcgtgttggagggtgcgtaaaatttttgttaaagttttatattttttagtagtgttttttattatttttatttggtttttttttaggttttagttcgtatttaaagttgttttttagtatagacgtgggcgataggttttttttttttaatttttaaagattattgaataggatttgggtcgtatttagtgcgtaggttttgcgggttttttggttgatgaacgtcggtagtttttaataataaatatttgtttgcgggtatggtacgttttgaagtagttaggttattcgtcgtggttttgtggtttttagcgagttttagtcggcgtcggggtcgggggttttaataggtaggttttaagttttaaattttaattttaatttagattttaatacgggttcggattttggagattttggagtaggggagatggtggttttttttcggggttagtttgttttaagtagcggagcgcgggggaagttcgaggttaaaggaggcggtgcgtttaggttttgttggcggaggcgtcgggtatcggtatagaggtttagtgacgcggcgtgggtgggtcgggaatgtttcgtgcgataggagttaggtgggttcggcgcggagattcgcgggagtcgggtcgcggcgggagcgcggtaggcggagaggttcgcggaggtagttaggttcggcgagaaaggttaaaattttttggttttattcgtagtgttttattcgggtacggtttgtgggattagtgtattcggggagttcgcggcgtttttgtttttttttgcgtttgtttttttaagattaacggaggatagaggtcgttttttttggttttgtggagtttcgtttttcgggtttagattttcgtaaggtttgttttttcggaatgttagtgtttaaattttggggtaggcgtttcggtgtgtgaataagagttttaaattcgtagtttttcgaattattttaagaaggggtttgaggaatttattttaaatttaaataaggtttaatatgtttgtagtttgggtcgaaatttaataattttaatataattaataaaggatatttttattttttgttttttaaattttttgggtatgtaaaattttttcgagttgtaaaattaatgattgggaaaaattgagttaaaagagattgtttaagatattattagtgttaaggattttatgatataagagatatagtaagatagtaagatcggtgtttttgtttggagttgaattgatgtatatttattttgagtttttttttagatttataatttttttgggtttttagatggtaatattttagtataatgtaatgtttaaatttcggaattattttgatttttgaaaaatgtttttttggttttagcgatataggattttgttttttttttataaattagtttatattataaattgtaaatatttgtaataagattttaagattgtttattttatataattttaagtatttgattatgttaaatattagtatagaaaatttgtgaaattagtttaatgtgtgtgagggaattaaaggattatttatttttattatataaataaagtatttaagattgttttgattgttagttttttaatttttagttatataattgattattaatttaagagttattttgtgtaaaaataattattgaggttatattttgttttaattaaatatttttgggtagaagaaaatggtattgtatattgggaagtgggggattgtttttaatattatattattttagtttaaacggaaataaaagtttgtaaattttaacggggaaaaaaggtttgaaatggttttttaatatgttattaaaatagttagttaaaatatattaaagtaatattataaatttagaaataataaatatgttattttaatgagaatgttaatttatagataatttatttaaggtagtttttatattttatatggaatgttttattatgattcgtttgattattgtgatgtttgttttttaaaatttaatttatataggtttgtaatatatataatttataatttttgttgatatacgtatatatattttaaattttaaatttttatagtatgtttggatgtttattagtatgtttttaagatgacgaaaataaaaatataaaaagtgttaaatattatattgaaagtaagtgtttgttttgttttatgtttgaaggtaaagtagttgaaaatgaaaaaattaaaaaggattagataatttttaagtttaggtattgagtgagtattgaaatattttagataaaaaaaaattttgtataagaaatttgaaaattttaagaaagatttatagatgtgagtgtataatatttttgatgtttagataattttttttttggtgtttaatttatgaaataaaaaattttcgagtttcggggtattttgttttgggtattttatatgttagttaaggtaattattatatatgttttcggtgtaggaaagtttagtataatacgcggagttttattggtatgaggaaaggttttagaatataattaaatatattaaatagggaggagtaaatatgtttttttttttgttgaataattttttatatgttttgagtaaggatttttgtagatttttatttaagtagaatagtgtatgtttaagagtatatattgtggagttatgttttattgttggatttaaattttattgttattgtttattagttttttgattttggataagttaatttttttgttttttagtttttttatttgtaaaatgtggataaaaatagtgtttattttatggaatggttaggaggattaaatgagttaatatttgtaaaatttttagaataatgttttgtatatgtatattaagtattaaataataattatttttattaaaaggttaatagatattgatttttgtaataaaaattttaaaagaaaaaaataataaagtgttgtaagataagaaaagtttttttttgtgggtaagaagaaaatattgtttgttagtttgtgattttggttaattgtttagtttgtgtgagttttatttagaagatgtgataattgttataatgtagtagtgtagttaggaggtttatttagaagagtaatttataggttgtgtgtttttatatgtaagatagataatattgttattttgttatgtatagttaataaggtgagattttaggtatggtatttgttttcgaggagtttattatttgggtaaaatagtttataaatatatatgatagtgttaggaagtatgtgttaaatgtatttgtttaaaggtattaggatatataatttgtgtatttgaatggttatataatatatgtgggtttgttgttttggttttggaaattaaattttttttggaaatgagtagttttataaaggaatggtgaagcgatatttagaggttaagaagcgtattttgttaggattaaatgtatattatatgttgtcgtggtttgtgttttatagtattatttgtattttttttggttgtttatgtttatcgagtattagtagtaaaacgttaaaagatataaaggttgttgattaaggatttttaatagtagtttgaaaatatatataaaataaagaaaggaatgtttaattattattatagggatttgtaagatgaataattgagttataattatagagtaaattaagaaggatttttttttaatgtttaaatttaggtatattattaatattgttttatattttatataatatttatgaagagttaagtattttttatatatttttatttgggatgtgttgttatagtatacggttaatttttagaggtagatatttttgattttaaatttttgttatattaattattagatgtaaagttttaggttattttttagttttttaaaatttatgattttttagtgttttgtagtatatattttgttaattattgtgaggattaaataaaaataagttatgtaaggtgtttggtatataataggttttaataaatgtatattttttttttatttttattatttattttttaaattattgtaatatagagaggatttttaatttatttttttgtgattagaagtagttttgaaaaattttgggaggtggtgtgtattttaattttaattttttattgtaagtattgataatgtgtgtttatattgtgtgtattg

SEQ ID NO: 106 - DNA, 10550 bp, Homo sapiens
ggaaagactatcccggatattttaatagtaacaggaacaaagatgactcgaaccccatcaaatgaaacgatattttcattcaattgatcgcaaagtgtcttcaattaataacttggcacttatttaaaaggtttaacagaattggaggcgacacattttgtactgacaacacgtcatgagataacatcttttgtttaaaataacttaatacactagaaaaaaatatgtcaaatataaataattttgttttcatggagaacaaatagttacaaagctcaaccgcataccaaagttcagttagaagagcttttcctctttcttgtaaattagaaggtaaaacaaaaacaaaaacaaaaccccacaaacttaggcttgctagcgaattgggatacagactggcttagtccaaggtatcccagtttaaatagctacatgaattgaaacaaacaaccaaaagaaaaaaaaaaacaaaaaagaaacaaacaaacaaaaaaaaaaggttacttgaatagatacacctttgtgagataaaatgcaaatgttgaaagtcagtccacacattatagtcaaaataaactttgttcgtgtgtatcaacatatcttacacaaacctagtgcctgtatctagctgggtgttatttaaggtgaatttgacgggatagagagggggaaataaaccactgtcttcaaataggacttcaggaaaccaacaagaaggaacacaagaaaaggggaatggtgggaactaatactgattgagcgcctactgtgtctggcacagcgaggcgctgtaccttcattatttcatttggtggtcttgttttctttttcctttccccacatattctgcccacctctgtcttcttaggacaatgagtgtaattttttccctttctgacttttttcttttgttccccaggatcaaagacagggcaaatatatatatatatatatatatatatatatatatatatatatggcaaatatatgatatatatatatggatatatatatatcaatttccagatacttttggtattgtttttcatagtgaagatgaaaatggagtgagtgcatgggagataagggggtgggaggagacacaccatcaatggaatacaagtaacatgcaaaccggaatttactgtcagcagtccagacagttttgccataataatttctcagagaaatcattgtctgtggcatttttttgtgttaatattatttttctctctcctcgttttaatattttctcttttcttgctcttccatacatggtgggtttaaactcaaagcatctgattcaacgtaaaaggaggcccgcctctctcatcaaatttctcgtgttaacgtgaacttcgcagaaaaaggtcagtttcaaaacctgtgaacttcccagctgcgcacttttttcatcttagttttttaaataagtatacctcttctttctgctttgccttcttagcgcatttttaaaaacacacatttaagttggtaactccccccagtctctcgagaatcgtctgggttgtttttccatatttttaaatgtataaaatactttaattttaaaatttgtttttgctccttggttctccaatttcagcttctgccaaatagcagttaagaaataagttcccttcctctttttctctcccgtttgtctttcgatttttttgtttgctcattttttcattgttaacaagatttttttttctatgcaagagtccatcgttgcagctttgcggtgagccaaactccgcggttccagcactcccctgtccagtctctctccagactcccccaaacccgctcctacaaaacccaattctaggccctcgagtaggaaaacgggcaggagccacggagcctgcgtgcctcgtgagatccctggtcctgcgtggagtctggctttccgagtccaagatgcgataggggacgagggatggtcagtgaggcgggaagagggccggctcccgaggtctcaaaggggtaacggagaagcagcggggcgcggagggcgtgcaggctgagtgccgcgggacaggcgcgacattggtgctggcgttggcgtcacagacccagggctgcggcgtgctttttggctttcagtctgagatcggcgatgctggagttcttgctggtggtcttggcggctgctgcggccgccactaccgaggcggcggaagccgaatccgcggccagcgtggcgagcggcagtccgaagggcggtgctgggaacatcatgtagggcgcgtgcgcggccaggtgcggatgcaggtggtggtgcgcgtgcgccacagcgctgtccagctgcagctgcgcctgaacctgaaaggacaagggcgtcacgttgcaatgactatcctagggtgacaacagaatagaaacagagcattaacggcgtccagcttggccagagagagagttgggttgtgtttgggcacggggagagggcatttggctgtgcatcttgttccgacagtgaccttctcagcctgttgctgaatctggggttccacatggatactccagtgtcccctgggtctccgaaactcgcttagggtaggcttatttccccggaccccgggaacccccttctgcaggaatgtggccgtctcccctgggaactgggctgaaatggtatattggaaagactgcgggtgaggacccttaccctcttctcttgatgctgccatgcatctcttaccccactaccaaaacaacggagtatcaacaagcaaactacgcaactttttaatgtcattcagggaagttactccatcttcaccacaataggcacaattgtgagtcggtacttctaacctttattgccataacaattacccagggatctcgttaaaattcagattctgattcgcaaggtctaggttggggcctgagattctgaatttctaacaatctcccagacggtgttgttgctgctggcccaaagattaccttttgagtagtaaaggtctccttttaaagtcacccctccctctttcttcagtcattctctcttgtttccaaagccaagcatcaggatgccagagtcctgtggcaccaagagagctaagatctccctaacaccgactctcaattcatggtcacacctatctgtctccccggtccaagtcactggagactgagagctaattcatgacatcacaggcatgccaagcaggggtcctggctgaggatagggaaggtcagacactggttgggaaaggatttcgccctcaggcttggaaagtggggagttcagagcactgggatttcccaggattaaatcattgctgcaggctgtccttttaaaatgtactcttaaaggtttctttatggctaagggattgcaaaggcagggcagccctgggaagaccaagacttctctctttaccagagatgaagctttgtttgcagaaacagatttaaaaacaaaagaacgaaaaaacaaaagtatgagctgggagtacttgtgtttatttttcttctgtcagagttatttaatgtgactaagaggtagaaaatacctagaaaagtatctagagggttgccttagaaataccttaggactaacctctgtattggatttgacaaaatcttaatcaaaaggcttttccttcctctctctctaagggcaatctttagtgtatttttaaaggaccagttactgcccccaggccccttcagggattcccatgaggacagaagggactaggcattcaggcctttaataccgtataggtttttaaagggtagtgggtccactatatcatctcaaaatgattctccaactatgcagacattgacatctgggctcagagacaggtgatgttcaacagttcaagcaaacattcaggtattttcatatttaaaaacagcttgaaactaggctgtacttgcctgctgaaatggcatccttaaagcacctacgttgacataaggtgcgactctacaagcttcaaactggctggcggcccctatgagaacacctgtaaaaagtacaagagaaaaataatgtgaggttaacgtttgtagcatttttcagggttccaaagggtacaagacagaacgaattcctttgaaaatggactattatctttctaaactgcatccaaaatttaaataaatgtaacttactcccaaactttaggactccattaacagcctttgaagattattaagtcaagaactattgtcatttttgaggttcctttttttctgtcattgtaatagtaatattcactacttctctctttgctcagactatcaaatgttccttgtataagaagcatacctttatggagttgattttcttgttttctacatttagctcttcgattttgaaaccaaacctataggttggagggggaaaaaaaataaaacctagatgttatgactaaaaatttttttaaattacaaaagtacaaagagaaaagagtcgtggtttagacaagaattgggagatacagcaagcaatctttgaattgtataaaacagcctcaaattccaaagttaaacatgtaaattaactacagaaatagaaagatagattttatagactttcacaagatagattactattagtcctgatttcatcttttcacataacagagtccccatggcctaaaactctgcttggtacctgataccaacatgataatggtttagatatttgcccagttaagacctgagaagaatgtgttcattaatagcctgtaatgttaattagcttcatcttaaagaaaaaccaaacaccagagcaaataatgactcctttgcggagaaggagttgtaagggttggggagaggtaattagtgtcataaaagcctcactacaaagaagtttagaatttctctgttctgctgtgcagcagagtgaaacacagtagcagaataattgtgcaccattatcatgataatctaatttgcttctttagaaaaagccactgtttgcagttaggatagtaggaaaacatctagaaaataactaaaatgtaaataaaagtatgaaacaacaataaagttcacttcttaagagaaaaaaagaagagcactcagcgaaaggagaatgaagtatatataaagcaagtaactcttaggtactttgttctcctggatgttacctgcttaaacttgacaacttttacaggcagtatgacagattttttaaaattcaaataaagcttgcttttgtattccactttcaataataaagcatattgattgactcacaaattaaagtttttaaaaccccattaaagtaaaaatactgcttcagagctttcattggtatgtttttgaaagcaagtgtcatagtcaatgtaaatcttcaaaaatttctctgctatttagtacaacagagggtggattttgtgccagggtggcatcctttgtgtaattcacatggcctgaggcttcttgcctttttttcccctagaagagttggaattaagatactaataatcataactgtaataattatcatcatgtttttaaggggttgctgagcctctggagatctcagtgcacagagcgaagcaggagaggcttaaaaaggaaggctctgctgctgatgctgtgatgaccaaggcagcctattattacttttcctcttcaacgtgactgctctgtttttttttttcctgatcctgttacaagatgtggggaagccccttaagaattgtgcatagttcgctacagatggtggtctctgtgcccagagaccgaaagagtatctgttacagcgatactttgtaacagctgcagatgtgcgggcctaaaactgctccatgtgttcaaaccaataataactatcattttattctattttattatctgagcggaaatacaatctgaaacatttaaatttgttccccctaaagctagaaggatatgtgtatgtgaatgtacacaatttgctcctttaaatgcccccaaagcctatttttgctattacatttgcctccacaaccaataaagaaaatctgtttcagtcctaacttcattgggtatggcacgtgctggagggcaggctttggaaatataaatactaatatatgtggtttgttttaaaatctaatgtatttagggtcagtttcgttgccttggttaaatgaatgaacaaagagtgaccaaaatgcgtttatttctccgctatttcacacacagtttgagatcgaccgctaacagcagactgtaaatttctgcacttaacagttactaattttctttatagtctgcacatctataaacctaattgggatatccgcttgacaaacctagaccctgcagagcagactttcaaggaaatccaactccagagaacaaaatactctttggaacttttaaggcatccagagataaaacgttttctgtgggatttttttttaagccttataaaagtaggcccattaggattaaaccacattaaagccagtgcgaggcaaggggggtgtggtttatagaaactctgggagaaagcccagcacagctttcttcttctgggaacatatgttaggatggaaaaaaaaaaaaggaggggagtgctataggactaagatctactttggaaaataagacctctagtaaagatatctctttccttctcatcttacaccagacactagaagcaccacctcccgagtgtgtcccccaagcctctttccaaccccaggctctctctgctccctgggccctcgacctcctggcagctgggtacctgcactcgggcctccgacaggcccagtcgctggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaagcgcaaaggtcaagtctgagcggccgcctggggcaaggtgggcagtcatccaccacctccttcacaaacgtacctcgactcaccgcctcactattcaccccccagtcaccggccttccccagcaaacaccaaatggtttccactcactttcgcactcacttgctccgcagcactcacagaaatcaaaggcgcagcgccaggcctctcacagagcaaagtctggacataagggcgcggcaaggccacccactggcctctcacaccggccattcccagaaggctggctcgttctcaggccagctctcaccaccgctggctctctgcctaccgcaaacttgctggtctaatttaggaacaattgggccgaaaggtatcagcgagagcaacagaccccggtgttgtgccgcacagggagccgcatccgcagacgcccctcgctgcccctgggctcgggccaaaccctgcataaggtcccctggacagccaggtaatctccgtcccgcctgcccgaccggggtcgcacgagcacaggcgcccacgccatgttggctgcccaaagggctcgccgcccaagccgggccagaaggcaggaggcggaaaaccagcctccggtggcgggcgaaagcaaccgctctttctgttctctcttcgccctccctcgtggaaacgcagactcgaccctaaacgcttaacccacagagatcaacaggttcaagcggaatattcgcgatcctcggtttctattggttgctcaaagccttttcatgcaaccagcagctcggatgtttaataaaatatgaatttttctgctctgggtttgcacacatccgttgccactttcctgtccttctcctccctttaaaaacaggagctcttctagtgtgagcatatacagccaccatatatatatccccctggaacctttatcctctgcgcccgaatcagagactccgggttttaagaagtcaaagctgagtttagatagtcgaggctgtttgcagttcttcccagcgcaggatccaggccagcatgggtgttaaaaatcatttccggaagagccggtctgcagagaaattaatacttgccctgagcttggaaatcaacaatcccaggaactgcgcccgccgggggttcagacctgaacctcgccgtcaggcgcgctggcgaacctgtagttcgggcctgtagttgtggactcatggccgggaggctgcactgggcaccttgacggtaactccaccactttacaaatttaggaagacctggtgctggtttggaggaagaagagtcgctagatctcggccctgccgggcattctagctacggtgatcttaaatattgccgtattttctagttctcagagttagttttgtggacatttgtcctttctttaggaaggaacattatagtaaacattatgggccaatttaatagcaaagtatttttactgatattgtattgaaatttaaatatgaaaacacacccttcaaattctgccaatgaggtgggaaggctttgtctattacatgtcatctacacagtggatgccactcaaagttttggggcttcgaggagatgtccaaatttcaagttgatccatagacttaataaaatctctatttttgtccccaaatttccaattactgatctaaacaggaacagaccgtgtcataaacaacttaattgcttgcttaaatatgtgattccacgcatgccacatattttcttaattggaaaaatatggcagtacaccagttactgcaggcaccaagtgccaaatcaattttattgttgaactcctttgaattggtatagaacgctctgccattgagataaagacgtttcctaacactgagctagcaccaaaggatttttgctctaagagaaccgagtactgggtgattgaaaacactaaaggaattgtgtaaatatagatccccacctcccccgccgccccccccccccgcccccaacacaccaagaaaccgaaacgcctcgcccgggagaagcagcgtagcctggacctcagctttcgttggcttccttctaccttgaaagagaatgggaagttttggcccctaagatccaaagattcaggggctctgcggagttcgaggggtcttggcggccccaaacacctaggcgaccggagggttaagctttccacctctgccccttctccctcccggcaaactctgcgctagaggctagctttagtcccgccgtctggttcagcaccccctcctgcagcccggccccgcgaacttccacgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgttaccctccgtcagtcgcgggctgcccggctccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttccttcttctttttttactgctccagcccccccaataataacacatcaatgggacaggaggtgggggaggagagggaggaggagaaagaagaagaaaaagaggagaagaaagaagaaagaggaggagaagtagaaggagaaaaagaagtaagaagaggaggaggaggaagaagaggaagagggggagaagggtgaagaggagagggaggaggaggaggagaagagaaggggcgggggctgccggagggaaatgggaactgatgcttccctgccggagcgcgcttgttcaatgttaagatctttgacaattcttcctgcggagagttcagatctgatagcgacgctgcgcttgaagtcccactatttatacttcctaacggcggcctcttgttttgagtaaattacctcccctcgcaactcgg

SEQ ID NO: 107 - DNA, 10550 bp, Artificial Sequence
  bisulfite converted genomic DNA
ggaaagattatttcggatattttaatagtaataggaataaagatgattcgaattttattaaatgaaacgatatttttatttaattgatcgtaaagtgtttttaattaataatttggtatttatttaaaaggtttaatagaattggaggcgatatattttgtattgataatacgttatgagataatattttttgtttaaaataatttaatatattagaaaaaaatatgttaaatataaataattttgtttttatggagaataaatagttataaagtttaatcgtatattaaagtttagttagaagagtttttttttttttttgtaaattagaaggtaaaataaaaataaaaataaaattttataaatttaggtttgttagcgaattgggatatagattggtttagtttaaggtattttagtttaaatagttatatgaattgaaataaataattaaaagaaaaaaaaaaataaaaaagaaataaataaataaaaaaaaaaggttatttgaatagatatatttttgtgagataaaatgtaaatgttgaaagttagtttatatattatagttaaaataaattttgttcgtgtgtattaatatattttatataaatttagtgtttgtatttagttgggtgttatttaaggtgaatttgacgggatagagagggggaaataaattattgtttttaaataggattttaggaaattaataagaaggaatataagaaaaggggaatggtgggaattaatattgattgagcgtttattgtgtttggtatagcgaggcgttgtatttttattattttatttggtggttttgtttttttttttttttttttatatattttgtttatttttgtttttttaggataatgagtgtaattttttttttttttgattttttttttttgttttttaggattaaagatagggtaaatatatatatatatatatatatatatatatatatatatatatggtaaatatatgatatatatatatggatatatatatattaatttttagatatttttggtattgttttttatagtgaagatgaaaatggagtgagtgtatgggagataagggggtgggaggagatatattattaatggaatataagtaatatgtaaatcggaatttattgttagtagtttagatagttttgttataataattttttagagaaattattgtttgtggtatttttttgtgttaatattattttttttttttttcgttttaatattttttttttttttgtttttttatatatggtgggtttaaatttaaagtatttgatttaacgtaaaaggaggttcgttttttttattaaatttttcgtgttaacgtgaatttcgtagaaaaaggttagttttaaaatttgtgaattttttagttgcgtattttttttattttagttttttaaataagtatattttttttttttgttttgtttttttagcgtatttttaaaaatatatatttaagttggtaattttttttagtttttcgagaatcgtttgggttgtttttttatatttttaaatgtataaaatattttaattttaaaatttgtttttgttttttggttttttaattttagtttttgttaaatagtagttaagaaataagttttttttttttttttttttttcgtttgtttttcgatttttttgtttgtttatttttttattgttaataagatttttttttttatgtaagagtttatcgttgtagttttgcggtgagttaaatttcgcggttttagtatttttttgtttagtttttttttagatttttttaaattcgtttttataaaatttaattttaggttttcgagtaggaaaacgggtaggagttacggagtttgcgtgtttcgtgagatttttggttttgcgtggagtttggtttttcgagtttaagatgcgataggggacgagggatggttagtgaggcgggaagagggtcggttttcgaggttttaaaggggtaacggagaagtagcggggcgcggagggcgtgtaggttgagtgtcgcgggataggcgcgatattggtgttggcgttggcgttatagatttagggttgcggcgtgttttttggtttttagtttgagatcggcgatgttggagtttttgttggtggttttggcggttgttgcggtcgttattatcgaggcggcggaagtcgaattcgcggttagcgtggcgagcggtagttcgaagggcggtgttgggaatattatgtagggcgcgtgcgcggttaggtgcggatgtaggtggtggtgcgcgtgcgttatagcgttgtttagttgtagttgcgtttgaatttgaaaggataagggcgttacgttgtaatgattattttagggtgataatagaatagaaatagagtattaacggcgtttagtttggttagagagagagttgggttgtgtttgggtacggggagagggtatttggttgtgtattttgtttcgatagtgatttttttagtttgttgttgaatttggggttttatatggatattttagtgttttttgggttttcgaaattcgtttagggtaggtttattttttcggatttcgggaatttttttttgtaggaatgtggtcgttttttttgggaattgggttgaaatggtatattggaaagattgcgggtgaggatttttattttttttttttgatgttgttatgtattttttattttattattaaaataacggagtattaataagtaaattacgtaattttttaatgttatttagggaagttattttatttttattataataggtataattgtgagtcggtatttttaatttttattgttataataattatttagggatttcgttaaaatttagattttgattcgtaaggtttaggttggggtttgagattttgaatttttaataattttttagacggtgttgttgttgttggtttaaagattattttttgagtagtaaaggtttttttttaaagttatttttttttttttttttagttatttttttttgtttttaaagttaagtattaggatgttagagttttgtggtattaagagagttaagatttttttaatatcgatttttaatttatggttatatttatttgttttttcggtttaagttattggagattgagagttaatttatgatattataggtatgttaagtaggggttttggttgaggatagggaaggttagatattggttgggaaaggatttcgtttttaggtttggaaagtggggagtttagagtattgggattttttaggattaaattattgttgtaggttgtttttttaaaatgtatttttaaaggtttttttatggttaagggattgtaaaggtagggtagttttgggaagattaagatttttttttttattagagatgaagttttgtttgtagaaatagatttaaaaataaaagaacgaaaaaataaaagtatgagttgggagtatttgtgtttattttttttttgttagagttatttaatgtgattaagaggtagaaaatatttagaaaagtatttagagggttgttttagaaatattttaggattaatttttgtattggatttgataaaattttaattaaaaggttttttttttttttttttttaagggtaatttttagtgtatttttaaaggattagttattgtttttaggtttttttagggatttttatgaggatagaagggattaggtatttaggtttttaatatcgtataggtttttaaagggtagtgggtttattatattattttaaaatgattttttaattatgtagatattgatatttgggtttagagataggtgatgtttaatagtttaagtaaatatttaggtatttttatatttaaaaatagtttgaaattaggttgtatttgtttgttgaaatggtatttttaaagtatttacgttgatataaggtgcgattttataagttttaaattggttggcggtttttatgagaatatttgtaaaaagtataagagaaaaataatgtgaggttaacgtttgtagtattttttagggttttaaagggtataagatagaacgaatttttttgaaaatggattattatttttttaaattgtatttaaaatttaaataaatgtaatttatttttaaattttaggattttattaatagtttttgaagattattaagttaagaattattgttatttttgaggtttttttttttttgttattgtaatagtaatatttattatttttttttttgtttagattattaaatgttttttgtataagaagtatatttttatggagttgatttttttgttttttatatttagtttttcgattttgaaattaaatttataggttggagggggaaaaaaaataaaatttagatgttatgattaaaaatttttttaaattataaaagtataaagagaaaagagtcgtggtttagataagaattgggagatatagtaagtaatttttgaattgtataaaatagttttaaattttaaagttaaatatgtaaattaattatagaaatagaaagatagattttatagatttttataagatagattattattagttttgattttatttttttatataatagagtttttatggtttaaaattttgtttggtatttgatattaatatgataatggtttagatatttgtttagttaagatttgagaagaatgtgtttattaatagtttgtaatgttaattagttttattttaaagaaaaattaaatattagagtaaataatgatttttttgcggagaaggagttgtaagggttggggagaggtaattagtgttataaaagttttattataaagaagtttagaatttttttgttttgttgtgtagtagagtgaaatatagtagtagaataattgtgtattattattatgataatttaatttgtttttttagaaaaagttattgtttgtagttaggatagtaggaaaatatttagaaaataattaaaatgtaaataaaagtatgaaataataataaagtttattttttaagagaaaaaaagaagagtatttagcgaaaggagaatgaagtatatataaagtaagtaatttttaggtattttgtttttttggatgttatttgtttaaatttgataatttttataggtagtatgatagattttttaaaatttaaataaagtttgtttttgtattttatttttaataataaagtatattgattgatttataaattaaagtttttaaaattttattaaagtaaaaatattgttttagagtttttattggtatgtttttgaaagtaagtgttatagttaatgtaaatttttaaaaatttttttgttatttagtataatagagggtggattttgtgttagggtggtattttttgtgtaatttatatggtttgaggttttttgttttttttttttttagaagagttggaattaagatattaataattataattgtaataattattattatgtttttaaggggttgttgagtttttggagattttagtgtatagagcgaagtaggagaggtttaaaaaggaaggttttgttgttgatgttgtgatgattaaggtagtttattattattttttttttttaacgtgattgttttgttttttttttttttgattttgttataagatgtggggaagttttttaagaattgtgtatagttcgttatagatggtggtttttgtgtttagagatcgaaagagtatttgttatagcgatattttgtaatagttgtagatgtgcgggtttaaaattgttttatgtgtttaaattaataataattattattttattttattttattatttgagcggaaatataatttgaaatatttaaatttgttttttttaaagttagaaggatatgtgtatgtgaatgtatataatttgtttttttaaatgtttttaaagtttatttttgttattatatttgtttttataattaataaagaaaatttgttttagttttaattttattgggtatggtacgtgttggagggtaggttttggaaatataaatattaatatatgtggtttgttttaaaatttaatgtatttagggttagtttcgttgttttggttaaatgaatgaataaagagtgattaaaatgcgtttattttttcgttattttatatatagtttgagatcgatcgttaatagtagattgtaaatttttgtatttaatagttattaattttttttatagtttgtatatttataaatttaattgggatattcgtttgataaatttagattttgtagagtagatttttaaggaaatttaattttagagaataaaatattttttggaatttttaaggtatttagagataaaacgttttttgtgggatttttttttaagttttataaaagtaggtttattaggattaaattatattaaagttagtgcgaggtaaggggggtgtggtttatagaaattttgggagaaagtttagtatagttttttttttttgggaatatatgttaggatggaaaaaaaaaaaaggaggggagtgttataggattaagatttattttggaaaataagatttttagtaaagatattttttttttttttattttatattagatattagaagtattatttttcgagtgtgttttttaagtttttttttaattttaggttttttttgttttttgggttttcgattttttggtagttgggtatttgtattcgggttttcgataggtttagtcgttggtttagtttttttcgtatgaaggcgtcgggatagtgggtttcgttaaaaagtttttttagtttattgagttgttttagggtgaaattggttcgatttcgtttttgtttgattttggtttggttttcgttttttatttttttcgtattttttttgcgattttttagtttcggggatattggagggggtattttagcggggttatacgtgtatttatacgaatatatatatatacgtatatatatacggacgaaaatagtatagtaaattttgttattagatttgtcgtaaaaaagaatagagaatttttttttttcgtggaattttggttcggttttttaatttattcggaggaagaatatttcggagaagcgtaaaggttaagtttgagcggtcgtttggggtaaggtgggtagttatttattattttttttataaacgtatttcgatttatcgttttattatttattttttagttatcggttttttttagtaaatattaaatggtttttatttattttcgtatttatttgtttcgtagtatttatagaaattaaaggcgtagcgttaggttttttatagagtaaagtttggatataagggcgcggtaaggttatttattggttttttatatcggttatttttagaaggttggttcgtttttaggttagtttttattatcgttggttttttgtttatcgtaaatttgttggtttaatttaggaataattgggtcgaaaggtattagcgagagtaatagatttcggtgttgtgtcgtatagggagtcgtattcgtagacgtttttcgttgtttttgggttcgggttaaattttgtataaggttttttggatagttaggtaattttcgtttcgtttgttcgatcggggtcgtacgagtataggcgtttacgttatgttggttgtttaaagggttcgtcgtttaagtcgggttagaaggtaggaggcggaaaattagttttcggtggcgggcgaaagtaatcgttttttttgtttttttttcgttttttttcgtggaaacgtagattcgattttaaacgtttaatttatagagattaataggtttaagcggaatattcgcgattttcggtttttattggttgtttaaagtttttttatgtaattagtagttcggatgtttaataaaatatgaatttttttgttttgggtttgtatatattcgttgttatttttttgttttttttttttttttaaaaataggagtttttttagtgtgagtatatatagttattatatatatatttttttggaatttttattttttgcgttcgaattagagatttcgggttttaagaagttaaagttgagtttagatagtcgaggttgtttgtagttttttttagcgtaggatttaggttagtatgggtgttaaaaattattttcggaagagtcggtttgtagagaaattaatatttgttttgagtttggaaattaataattttaggaattgcgttcgtcgggggtttagatttgaatttcgtcgttaggcgcgttggcgaatttgtagttcgggtttgtagttgtggatttatggtcgggaggttgtattgggtattttgacggtaattttattattttataaatttaggaagatttggtgttggtttggaggaagaagagtcgttagatttcggttttgtcgggtattttagttacggtgattttaaatattgtcgtattttttagtttttagagttagttttgtggatatttgttttttttttaggaaggaatattatagtaaatattatgggttaatttaatagtaaagtatttttattgatattgtattgaaatttaaatatgaaaatatattttttaaattttgttaatgaggtgggaaggttttgtttattatatgttatttatatagtggatgttatttaaagttttggggtttcgaggagatgtttaaattttaagttgatttatagatttaataaaatttttatttttgtttttaaatttttaattattgatttaaataggaatagatcgtgttataaataatttaattgtttgtttaaatatgtgattttacgtatgttatatatttttttaattggaaaaatatggtagtatattagttattgtaggtattaagtgttaaattaattttattgttgaatttttttgaattggtatagaacgttttgttattgagataaagacgttttttaatattgagttagtattaaaggatttttgttttaagagaatcgagtattgggtgattgaaaatattaaaggaattgtgtaaatatagatttttatttttttcgtcgtttttttttttcgtttttaatatattaagaaatcgaaacgtttcgttcgggagaagtagcgtagtttggattttagttttcgttggtttttttttattttgaaagagaatgggaagttttggtttttaagatttaaagatttaggggttttgcggagttcgaggggttttggcggttttaaatatttaggcgatcggagggttaagttttttatttttgttttttttttttttcggtaaattttgcgttagaggttagttttagtttcgtcgtttggtttagtatttttttttgtagttcggtttcgcgaatttttacgttcgtttgcgggttattcgggttgcgggtttattttttcgttggtgaaaaatgtatttcggtggaatgggaatatttgggaagggcgcgtataaattttatacgtttttttttacgttatttttataatatattaggattttatttatgatcgagtatattatcggatttttatttttttattattattttagttgataaagttggggtttagggtttttttcgtgtttttttttttttttcgttgggtttcggagttttttttcgttcgagaggagttcggaaggcgggaaggggaatcgttgtcgggggttagttaggtcgttatttttcgttagtcgcgggttgttcggttttttgtttttttcggcggcgtttatgtttagttttcggacgggagagcgtttttttttagttttttcgtttgttttttttttttttatatttttttcgtttttttcgtcgtcgttttcgtttttttcgtcgtcgttttcgtcggtcgttcggattgtcgggttgttgcggtcgtcgcggttcgtttcggtgtagtcggtcggttttttggtttcgcgtagcggttcgttttttagtatttttcggtacgtgatcgtttttttttttttttttattttttggttaaaagatttggagacgaacgtcgtaagtttttttatcgtcgtcgtacgttagttcggcgtttaatttttgttagtagagtttcgtttttttttttttttttttttttttattgttttagtttttttaataataatatattaatgggataggaggtgggggaggagagggaggaggagaaagaagaagaaaaagaggagaagaaagaagaaagaggaggagaagtagaaggagaaaaagaagtaagaagaggaggaggaggaagaagaggaagagggggagaagggtgaagaggagagggaggaggaggaggagaagagaaggggcgggggttgtcggagggaaatgggaattgatgtttttttgtcggagcgcgtttgtttaatgttaagatttttgataattttttttgcggagagtttagatttgatagcgacgttgcgtttgaagttttattatttatattttttaacggcggttttttgttttgagtaaattattttttttcgtaattcgg

SEQ ID NO: 108 - DNA, 10550 bp, Artificial Sequence
  bisulfite converted genomic DNA
ccgaattacgaaaaaaaataatttactcaaaacaaaaaaccgccgttaaaaaatataaataataaaacttcaaacgcaacgtcgctatcaaatctaaactctccgcaaaaaaaattatcaaaaatcttaacattaaacaaacgcgctccgacaaaaaaacatcaattcccatttccctccgacaacccccgccccttctcttctcctcctcctcctccctctcctcttcacccttctccccctcttcctcttcttcctcctcctcctcttcttacttctttttctccttctacttctcctcctctttcttctttcttctcctctttttcttcttctttctcctcctccctctcctcccccacctcctatcccattaatatattattattaaaaaaactaaaacaataaaaaaaaaaaaaaaaaaaaaaaaacgaaactctactaacaaaaattaaacgccgaactaacgtacgacgacgataaaaaaacttacgacgttcgtctccaaatcttttaaccaaaaaataaaaaaaaaaaaaaaaacgatcacgtaccgaaaaatactaaaaaacgaaccgctacgcgaaaccaaaaaaccgaccgactacaccgaaacgaaccgcgacgaccgcaacaacccgacaatccgaacgaccgacgaaaacgacgacgaaaaaaacgaaaacgacgacgaaaaaaacgaaaaaaatataaaaaaaaaaaaaacaaacgaaaaaactaaaaaaaaacgctctcccgtccgaaaactaaacataaacgccgccgaaaaaaacaaaaaaccgaacaacccgcgactaacgaaaaataacgacctaactaacccccgacaacgattccccttcccgccttccgaactcctctcgaacgaaaaaaaactccgaaacccaacgaaaaaaaaaaaaaaacacgaaaaaaaccctaaaccccaactttatcaactaaaataataataaaaaaataaaaatccgataatatactcgatcataaataaaatcctaatatattataaaaataacgtaaaaaaaaacgtataaaatttatacgcgcccttcccaaatattcccattccaccgaaatacatttttcaccaacgaaaaaataaacccgcaacccgaataacccgcaaacgaacgtaaaaattcgcgaaaccgaactacaaaaaaaaatactaaaccaaacgacgaaactaaaactaacctctaacgcaaaatttaccgaaaaaaaaaaaaaacaaaaataaaaaacttaaccctccgatcgcctaaatatttaaaaccgccaaaacccctcgaactccgcaaaacccctaaatctttaaatcttaaaaaccaaaacttcccattctctttcaaaataaaaaaaaaccaacgaaaactaaaatccaaactacgctacttctcccgaacgaaacgtttcgatttcttaatatattaaaaacgaaaaaaaaaaacgacgaaaaaaataaaaatctatatttacacaattcctttaatattttcaatcacccaatactcgattctcttaaaacaaaaatcctttaatactaactcaatattaaaaaacgtctttatctcaataacaaaacgttctataccaattcaaaaaaattcaacaataaaattaatttaacacttaatacctacaataactaatatactaccatatttttccaattaaaaaaatatataacatacgtaaaatcacatatttaaacaaacaattaaattatttataacacgatctattcctatttaaatcaataattaaaaatttaaaaacaaaaataaaaattttattaaatctataaatcaacttaaaatttaaacatctcctcgaaaccccaaaactttaaataacatccactatataaataacatataataaacaaaaccttcccacctcattaacaaaatttaaaaaatatattttcatatttaaatttcaatacaatatcaataaaaatactttactattaaattaacccataatatttactataatattccttcctaaaaaaaaaacaaatatccacaaaactaactctaaaaactaaaaaatacgacaatatttaaaatcaccgtaactaaaatacccgacaaaaccgaaatctaacgactcttcttcctccaaaccaacaccaaatcttcctaaatttataaaataataaaattaccgtcaaaatacccaatacaacctcccgaccataaatccacaactacaaacccgaactacaaattcgccaacgcgcctaacgacgaaattcaaatctaaacccccgacgaacgcaattcctaaaattattaatttccaaactcaaaacaaatattaatttctctacaaaccgactcttccgaaaataatttttaacacccatactaacctaaatcctacgctaaaaaaaactacaaacaacctcgactatctaaactcaactttaacttcttaaaacccgaaatctctaattcgaacgcaaaaaataaaaattccaaaaaaatatatatataataactatatatactcacactaaaaaaactcctatttttaaaaaaaaaaaaaaaacaaaaaaataacaacgaatatatacaaacccaaaacaaaaaaattcatattttattaaacatccgaactactaattacataaaaaaactttaaacaaccaataaaaaccgaaaatcgcgaatattccgcttaaacctattaatctctataaattaaacgtttaaaatcgaatctacgtttccacgaaaaaaaacgaaaaaaaaacaaaaaaaacgattactttcgcccgccaccgaaaactaattttccgcctcctaccttctaacccgacttaaacgacgaaccctttaaacaaccaacataacgtaaacgcctatactcgtacgaccccgatcgaacaaacgaaacgaaaattacctaactatccaaaaaaccttatacaaaatttaacccgaacccaaaaacaacgaaaaacgtctacgaatacgactccctatacgacacaacaccgaaatctattactctcgctaatacctttcgacccaattattcctaaattaaaccaacaaatttacgataaacaaaaaaccaacgataataaaaactaacctaaaaacgaaccaaccttctaaaaataaccgatataaaaaaccaataaataaccttaccgcgcccttatatccaaactttactctataaaaaacctaacgctacgcctttaatttctataaatactacgaaacaaataaatacgaaaataaataaaaaccatttaatatttactaaaaaaaaccgataactaaaaaataaataataaaacgataaatcgaaatacgtttataaaaaaaataataaataactacccaccttaccccaaacgaccgctcaaacttaacctttacgcttctccgaaatattcttcctccgaataaattaaaaaaccgaaccaaaattccacgaaaaaaaaaaattctctattcttttttacgacaaatctaataacaaaatttactatactattttcgtccgtatatatatacgtatatatatatattcgtataaatacacgtataaccccgctaaaataccccctccaatatccccgaaactaaaaaatcgcaaaaaaaatacgaaaaaaataaaaaacgaaaaccaaaccaaaatcaaacaaaaacgaaatcgaaccaatttcaccctaaaacaactcaataaactaaaaaaactttttaacgaaacccactatcccgacgccttcatacgaaaaaaactaaaccaacgactaaacctatcgaaaacccgaatacaaatacccaactaccaaaaaatcgaaaacccaaaaaacaaaaaaaacctaaaattaaaaaaaaacttaaaaaacacactcgaaaaataatacttctaatatctaatataaaataaaaaaaaaaaaaatatctttactaaaaatcttattttccaaaataaatcttaatcctataacactcccctccttttttttttttccatcctaacatatattcccaaaaaaaaaaaactatactaaactttctcccaaaatttctataaaccacaccccccttacctcgcactaactttaatataatttaatcctaataaacctacttttataaaacttaaaaaaaaatcccacaaaaaacgttttatctctaaataccttaaaaattccaaaaaatattttattctctaaaattaaatttccttaaaaatctactctacaaaatctaaatttatcaaacgaatatcccaattaaatttataaatatacaaactataaaaaaaattaataactattaaatacaaaaatttacaatctactattaacgatcgatctcaaactatatataaaataacgaaaaaataaacgcattttaatcactctttattcattcatttaaccaaaacaacgaaactaaccctaaatacattaaattttaaaacaaaccacatatattaatatttatatttccaaaacctaccctccaacacgtaccatacccaataaaattaaaactaaaacaaattttctttattaattataaaaacaaatataataacaaaaataaactttaaaaacatttaaaaaaacaaattatatacattcacatacacatatccttctaactttaaaaaaaacaaatttaaatatttcaaattatatttccgctcaaataataaaataaaataaaataataattattattaatttaaacacataaaacaattttaaacccgcacatctacaactattacaaaatatcgctataacaaatactctttcgatctctaaacacaaaaaccaccatctataacgaactatacacaattcttaaaaaacttccccacatcttataacaaaatcaaaaaaaaaaaaaacaaaacaatcacgttaaaaaaaaaaaataataataaactaccttaatcatcacaacatcaacaacaaaaccttcctttttaaacctctcctacttcgctctatacactaaaatctccaaaaactcaacaaccccttaaaaacataataataattattacaattataattattaatatcttaattccaactcttctaaaaaaaaaaaaaacaaaaaacctcaaaccatataaattacacaaaaaataccaccctaacacaaaatccaccctctattatactaaataacaaaaaaatttttaaaaatttacattaactataacacttactttcaaaaacataccaataaaaactctaaaacaatatttttactttaataaaattttaaaaactttaatttataaatcaatcaatatactttattattaaaaataaaatacaaaaacaaactttatttaaattttaaaaaatctatcatactacctataaaaattatcaaatttaaacaaataacatccaaaaaaacaaaatacctaaaaattacttactttatatatacttcattctcctttcgctaaatactcttctttttttctcttaaaaaataaactttattattatttcatacttttatttacattttaattattttctaaatattttcctactatcctaactacaaacaataactttttctaaaaaaacaaattaaattatcataataataatacacaattattctactactatatttcactctactacacaacaaaacaaaaaaattctaaacttctttataataaaacttttataacactaattacctctccccaacccttacaactccttctccgcaaaaaaatcattatttactctaatatttaatttttctttaaaataaaactaattaacattacaaactattaataaacacattcttctcaaatcttaactaaacaaatatctaaaccattatcatattaatatcaaataccaaacaaaattttaaaccataaaaactctattatataaaaaaataaaatcaaaactaataataatctatcttataaaaatctataaaatctatctttctatttctataattaatttacatatttaactttaaaatttaaaactattttatacaattcaaaaattacttactatatctcccaattcttatctaaaccacgactcttttctctttatacttttataatttaaaaaaatttttaatcataacatctaaattttattttttttccccctccaacctataaatttaatttcaaaatcgaaaaactaaatataaaaaacaaaaaaatcaactccataaaaatatacttcttatacaaaaaacatttaataatctaaacaaaaaaaaaaataataaatattactattacaataacaaaaaaaaaaaaacctcaaaaataacaataattcttaacttaataatcttcaaaaactattaataaaatcctaaaatttaaaaataaattacatttatttaaattttaaatacaatttaaaaaaataataatccattttcaaaaaaattcgttctatcttataccctttaaaaccctaaaaaatactacaaacgttaacctcacattatttttctcttatactttttacaaatattctcataaaaaccgccaaccaatttaaaacttataaaatcgcaccttatatcaacgtaaatactttaaaaataccatttcaacaaacaaatacaacctaatttcaaactatttttaaatataaaaatacctaaatatttacttaaactattaaacatcacctatctctaaacccaaatatcaatatctacataattaaaaaatcattttaaaataatataataaacccactaccctttaaaaacctatacgatattaaaaacctaaatacctaatcccttctatcctcataaaaatccctaaaaaaacctaaaaacaataactaatcctttaaaaatacactaaaaattacccttaaaaaaaaaaaaaaaaaaaaccttttaattaaaattttatcaaatccaatacaaaaattaatcctaaaatatttctaaaacaaccctctaaatacttttctaaatattttctacctcttaatcacattaaataactctaacaaaaaaaaaataaacacaaatactcccaactcatacttttattttttcgttcttttatttttaaatctatttctacaaacaaaacttcatctctaataaaaaaaaaaatcttaatcttcccaaaactaccctacctttacaatcccttaaccataaaaaaacctttaaaaatacattttaaaaaaacaacctacaacaataatttaatcctaaaaaatcccaatactctaaactccccactttccaaacctaaaaacgaaatcctttcccaaccaatatctaaccttccctatcctcaaccaaaacccctacttaacatacctataatatcataaattaactctcaatctccaataacttaaaccgaaaaaacaaataaatataaccataaattaaaaatcgatattaaaaaaatcttaactctcttaataccacaaaactctaacatcctaatacttaactttaaaaacaaaaaaaaataactaaaaaaaaaaaaaaaaataactttaaaaaaaaacctttactactcaaaaaataatctttaaaccaacaacaacaacaccgtctaaaaaattattaaaaattcaaaatctcaaaccccaacctaaaccttacgaatcaaaatctaaattttaacgaaatccctaaataattattataacaataaaaattaaaaataccgactcacaattatacctattataataaaaataaaataacttccctaaataacattaaaaaattacgtaatttacttattaatactccgttattttaataataaaataaaaaatacataacaacatcaaaaaaaaaaaataaaaatcctcacccgcaatctttccaatataccatttcaacccaattcccaaaaaaaacgaccacattcctacaaaaaaaaattcccgaaatccgaaaaaataaacctaccctaaacgaatttcgaaaacccaaaaaacactaaaatatccatataaaaccccaaattcaacaacaaactaaaaaaatcactatcgaaacaaaatacacaaccaaataccctctccccgtacccaaacacaacccaactctctctctaaccaaactaaacgccgttaatactctatttctattctattatcaccctaaaataatcattacaacgtaacgcccttatcctttcaaattcaaacgcaactacaactaaacaacgctataacgcacgcgcaccaccacctacatccgcacctaaccgcgcacgcgccctacataatattcccaacaccgcccttcgaactaccgctcgccacgctaaccgcgaattcgacttccgccgcctcgataataacgaccgcaacaaccgccaaaaccaccaacaaaaactccaacatcgccgatctcaaactaaaaaccaaaaaacacgccgcaaccctaaatctataacgccaacgccaacaccaatatcgcgcctatcccgcgacactcaacctacacgccctccgcgccccgctacttctccgttacccctttaaaacctcgaaaaccgaccctcttcccgcctcactaaccatccctcgtcccctatcgcatcttaaactcgaaaaaccaaactccacgcaaaaccaaaaatctcacgaaacacgcaaactccgtaactcctacccgttttcctactcgaaaacctaaaattaaattttataaaaacgaatttaaaaaaatctaaaaaaaaactaaacaaaaaaatactaaaaccgcgaaatttaactcaccgcaaaactacaacgataaactcttacataaaaaaaaaaatcttattaacaataaaaaaataaacaaacaaaaaaatcgaaaaacaaacgaaaaaaaaaaaaaaaaaaaaaacttatttcttaactactatttaacaaaaactaaaattaaaaaaccaaaaaacaaaaacaaattttaaaattaaaatattttatacatttaaaaatataaaaaaacaacccaaacgattctcgaaaaactaaaaaaaattaccaacttaaatatatatttttaaaaatacgctaaaaaaacaaaacaaaaaaaaaaaatatacttatttaaaaaactaaaataaaaaaaatacgcaactaaaaaattcacaaattttaaaactaacctttttctacgaaattcacgttaacacgaaaaatttaataaaaaaaacgaacctccttttacgttaaatcaaatactttaaatttaaacccaccatatataaaaaaacaaaaaaaaaaaaaatattaaaacgaaaaaaaaaaaaaataatattaacacaaaaaaataccacaaacaataatttctctaaaaaattattataacaaaactatctaaactactaacaataaattccgatttacatattacttatattccattaataatatatctcctcccacccccttatctcccatacactcactccattttcatcttcactataaaaaacaataccaaaaatatctaaaaattaatatatatatatccatatatatatatcatatatttaccatatatatatatatatatatatatatatatatatatatatatttaccctatctttaatcctaaaaaacaaaaaaaaaaaatcaaaaaaaaaaaaaattacactcattatcctaaaaaaacaaaaataaacaaaatatataaaaaaaaaaaaaaaaaaacaaaaccaccaaataaaataataaaaatacaacgcctcgctataccaaacacaataaacgctcaatcaatattaattcccaccattccccttttcttatattccttcttattaatttcctaaaatcctatttaaaaacaataatttatttccccctctctatcccgtcaaattcaccttaaataacacccaactaaatacaaacactaaatttatataaaatatattaatacacacgaacaaaatttattttaactataatatataaactaactttcaacatttacattttatctcacaaaaatatatctattcaaataaccttttttttttatttatttatttcttttttatttttttttttcttttaattatttatttcaattcatataactatttaaactaaaataccttaaactaaaccaatctatatcccaattcgctaacaaacctaaatttataaaattttatttttatttttattttaccttctaatttacaaaaaaaaaaaaaaactcttctaactaaactttaatatacgattaaactttataactatttattctccataaaaacaaaattatttatatttaacatatttttttctaatatattaaattattttaaacaaaaaatattatctcataacgtattatcaatacaaaatatatcgcctccaattctattaaaccttttaaataaataccaaattattaattaaaaacactttacgatcaattaaataaaaatatcgtttcatttaataaaattcgaatcatctttattcctattactattaaaatatccgaaataatctttcc

SEQ ID NO: 109 - DNA, 10550 bp, Artificial Sequence
  bisulfite converted genomic DNA
aaaaaaactatcccgaatattttaataataacaaaaacaaaaataactcgaaccccatcaaataaaacgatattttcattcaattaatcgcaaaatatcttcaattaataacttaacacttatttaaaaaatttaacaaaattaaaaacgacacattttatactaacaacacgtcataaaataacatcttttatttaaaataacttaatacactaaaaaaaaatatatcaaatataaataattttattttcataaaaaacaaataattacaaaactcaaccgcataccaaaattcaattaaaaaaacttttcctctttcttataaattaaaaaataaaacaaaaacaaaaacaaaaccccacaaacttaaacttactaacgaattaaaatacaaactaacttaatccaaaatatcccaatttaaataactacataaattaaaacaaacaaccaaaaaaaaaaaaaaaacaaaaaaaaaacaaacaaacaaaaaaaaaaaattacttaaataaatacacctttataaaataaaatacaaatattaaaaatcaatccacacattataatcaaaataaactttattcgtatatatcaacatatcttacacaaacctaatacctatatctaactaaatattatttaaaataaatttaacgaaataaaaaaaaaaaaataaaccactatcttcaaataaaacttcaaaaaaccaacaaaaaaaaacacaaaaaaaaaaaaataataaaaactaatactaattaaacgcctactatatctaacacaacgaaacgctataccttcattatttcatttaataatcttattttctttttcctttccccacatattctacccacctctatcttcttaaaacaataaatataattttttccctttctaacttttttcttttattccccaaaatcaaaaacaaaacaaatatatatatatatatatatatatatatatatatatatatataacaaatatataatatatatatataaatatatatatatcaatttccaaatacttttaatattatttttcataataaaaataaaaataaaataaatacataaaaaataaaaaaataaaaaaaaacacaccatcaataaaatacaaataacatacaaaccgaaatttactatcaacaatccaaacaattttaccataataatttctcaaaaaaatcattatctataacatttttttatattaatattatttttctctctcctcgttttaatattttctcttttcttactcttccatacataataaatttaaactcaaaacatctaattcaacgtaaaaaaaaacccgcctctctcatcaaatttctcgtattaacgtaaacttcgcaaaaaaaaatcaatttcaaaacctataaacttcccaactacgcacttttttcatcttaattttttaaataaatatacctcttctttctactttaccttcttaacgcatttttaaaaacacacatttaaattaataactccccccaatctctcgaaaatcgtctaaattatttttccatatttttaaatatataaaatactttaattttaaaatttatttttactccttaattctccaatttcaacttctaccaaataacaattaaaaaataaattcccttcctctttttctctcccgtttatctttcgatttttttatttactcattttttcattattaacaaaatttttttttctatacaaaaatccatcgttacaactttacgataaaccaaactccgcgattccaacactcccctatccaatctctctccaaactcccccaaacccgctcctacaaaacccaattctaaaccctcgaataaaaaaacgaacaaaaaccacgaaacctacgtacctcgtaaaatccctaatcctacgtaaaatctaactttccgaatccaaaatacgataaaaaacgaaaaataatcaataaaacgaaaaaaaaaccgactcccgaaatctcaaaaaaataacgaaaaaacaacgaaacgcgaaaaacgtacaaactaaataccgcgaaacaaacgcgacattaatactaacgttaacgtcacaaacccaaaactacgacgtactttttaactttcaatctaaaatcgacgatactaaaattcttactaataatcttaacgactactacgaccgccactaccgaaacgacgaaaaccgaatccgcgaccaacgtaacgaacgacaatccgaaaaacgatactaaaaacatcatataaaacgcgtacgcgaccaaatacgaatacaaataataatacgcgtacgccacaacgctatccaactacaactacgcctaaacctaaaaaaacaaaaacgtcacgttacaataactatcctaaaataacaacaaaataaaaacaaaacattaacgacgtccaacttaaccaaaaaaaaaattaaattatatttaaacacgaaaaaaaaacatttaactatacatcttattccgacaataaccttctcaacctattactaaatctaaaattccacataaatactccaatatcccctaaatctccgaaactcgcttaaaataaacttatttccccgaaccccgaaaacccccttctacaaaaatataaccgtctcccctaaaaactaaactaaaataatatattaaaaaaactacgaataaaaacccttaccctcttctcttaatactaccatacatctcttaccccactaccaaaacaacgaaatatcaacaaacaaactacgcaactttttaatatcattcaaaaaaattactccatcttcaccacaataaacacaattataaatcgatacttctaacctttattaccataacaattacccaaaaatctcgttaaaattcaaattctaattcgcaaaatctaaattaaaacctaaaattctaaatttctaacaatctcccaaacgatattattactactaacccaaaaattaccttttaaataataaaaatctccttttaaaatcacccctccctctttcttcaatcattctctcttatttccaaaaccaaacatcaaaataccaaaatcctataacaccaaaaaaactaaaatctccctaacaccgactctcaattcataatcacacctatctatctccccgatccaaatcactaaaaactaaaaactaattcataacatcacaaacataccaaacaaaaatcctaactaaaaataaaaaaaatcaaacactaattaaaaaaaaatttcgccctcaaacttaaaaaataaaaaattcaaaacactaaaatttcccaaaattaaatcattactacaaactatccttttaaaatatactcttaaaaatttctttataactaaaaaattacaaaaacaaaacaaccctaaaaaaaccaaaacttctctctttaccaaaaataaaactttatttacaaaaacaaatttaaaaacaaaaaaacgaaaaaacaaaaatataaactaaaaatacttatatttatttttcttctatcaaaattatttaatataactaaaaaataaaaaatacctaaaaaaatatctaaaaaattaccttaaaaataccttaaaactaacctctatattaaatttaacaaaatcttaatcaaaaaacttttccttcctctctctctaaaaacaatctttaatatatttttaaaaaaccaattactacccccaaaccccttcaaaaattcccataaaaacaaaaaaaactaaacattcaaacctttaataccgtataaatttttaaaaaataataaatccactatatcatctcaaaataattctccaactatacaaacattaacatctaaactcaaaaacaaataatattcaacaattcaaacaaacattcaaatattttcatatttaaaaacaacttaaaactaaactatacttacctactaaaataacatccttaaaacacctacgttaacataaaatacgactctacaaacttcaaactaactaacgacccctataaaaacacctataaaaaatacaaaaaaaaaataatataaaattaacgtttataacatttttcaaaattccaaaaaatacaaaacaaaacgaattcctttaaaaataaactattatctttctaaactacatccaaaatttaaataaatataacttactcccaaactttaaaactccattaacaacctttaaaaattattaaatcaaaaactattatcatttttaaaattcctttttttctatcattataataataatattcactacttctctctttactcaaactatcaaatattccttatataaaaaacatacctttataaaattaattttcttattttctacatttaactcttcgattttaaaaccaaacctataaattaaaaaaaaaaaaaaaataaaacctaaatattataactaaaaatttttttaaattacaaaaatacaaaaaaaaaaaaatcgtaatttaaacaaaaattaaaaaatacaacaaacaatctttaaattatataaaacaacctcaaattccaaaattaaacatataaattaactacaaaaataaaaaaataaattttataaactttcacaaaataaattactattaatcctaatttcatcttttcacataacaaaatccccataacctaaaactctacttaatacctaataccaacataataataatttaaatatttacccaattaaaacctaaaaaaaatatattcattaataacctataatattaattaacttcatcttaaaaaaaaaccaaacaccaaaacaaataataactcctttacgaaaaaaaaattataaaaattaaaaaaaaataattaatatcataaaaacctcactacaaaaaaatttaaaatttctctattctactatacaacaaaataaaacacaataacaaaataattatacaccattatcataataatctaatttacttctttaaaaaaaaccactatttacaattaaaataataaaaaaacatctaaaaaataactaaaatataaataaaaatataaaacaacaataaaattcacttcttaaaaaaaaaaaaaaaaaacactcaacgaaaaaaaaataaaatatatataaaacaaataactcttaaatactttattctcctaaatattacctacttaaacttaacaacttttacaaacaatataacaaattttttaaaattcaaataaaacttacttttatattccactttcaataataaaacatattaattaactcacaaattaaaatttttaaaaccccattaaaataaaaatactacttcaaaactttcattaatatatttttaaaaacaaatatcataatcaatataaatcttcaaaaatttctctactatttaatacaacaaaaaataaattttataccaaaataacatcctttatataattcacataacctaaaacttcttacctttttttcccctaaaaaaattaaaattaaaatactaataatcataactataataattatcatcatatttttaaaaaattactaaacctctaaaaatctcaatacacaaaacgaaacaaaaaaaacttaaaaaaaaaaactctactactaatactataataaccaaaacaacctattattacttttcctcttcaacgtaactactctatttttttttttcctaatcctattacaaaatataaaaaaaccccttaaaaattatacataattcgctacaaataataatctctatacccaaaaaccgaaaaaatatctattacaacgatactttataacaactacaaatatacgaacctaaaactactccatatattcaaaccaataataactatcattttattctattttattatctaaacgaaaatacaatctaaaacatttaaatttattccccctaaaactaaaaaaatatatatatataaatatacacaatttactcctttaaatacccccaaaacctatttttactattacatttacctccacaaccaataaaaaaaatctatttcaatcctaacttcattaaatataacacgtactaaaaaacaaactttaaaaatataaatactaatatatataatttattttaaaatctaatatatttaaaatcaatttcgttaccttaattaaataaataaacaaaaaataaccaaaatacgtttatttctccgctatttcacacacaatttaaaatcgaccgctaacaacaaactataaatttctacacttaacaattactaattttctttataatctacacatctataaacctaattaaaatatccgcttaacaaacctaaaccctacaaaacaaactttcaaaaaaatccaactccaaaaaacaaaatactctttaaaacttttaaaacatccaaaaataaaacgttttctataaaatttttttttaaaccttataaaaataaacccattaaaattaaaccacattaaaaccaatacgaaacaaaaaaaatataatttataaaaactctaaaaaaaaacccaacacaactttcttcttctaaaaacatatattaaaataaaaaaaaaaaaaaaaaaaaaaatactataaaactaaaatctactttaaaaaataaaacctctaataaaaatatctctttccttctcatcttacaccaaacactaaaaacaccacctcccgaatatatcccccaaacctctttccaaccccaaactctctctactccctaaaccctcgacctcctaacaactaaatacctacactcgaacctccgacaaacccaatcgctaactcaattcctctcgcataaaaacgtcgaaataataaatctcgtcaaaaaacctctccaactcattaaattattccaaaataaaattaatccgacttcgcctctacttaattttaatctaaccttcgtcctccatccctttcgcatcctctttacgatctttcaactccgaaaacactaaaaaaaacaccccaacgaaaccacacgtacatccacacgaacacacacacacacgcacacacacacgaacgaaaacaacacaacaaatcctattaccaaatttatcgcaaaaaaaaataaaaaatccttccccctcgtaaaatcctaatccgacttctcaacccacccgaaaaaaaaatatcccgaaaaaacgcaaaaatcaaatctaaacgaccgcctaaaacaaaataaacaatcatccaccacctccttcacaaacgtacctcgactcaccgcctcactattcaccccccaatcaccgaccttccccaacaaacaccaaataatttccactcactttcgcactcacttactccgcaacactcacaaaaatcaaaaacgcaacgccaaacctctcacaaaacaaaatctaaacataaaaacgcgacaaaaccacccactaacctctcacaccgaccattcccaaaaaactaactcgttctcaaaccaactctcaccaccgctaactctctacctaccgcaaacttactaatctaatttaaaaacaattaaaccgaaaaatatcaacgaaaacaacaaaccccgatattataccgcacaaaaaaccgcatccgcaaacgcccctcgctacccctaaactcgaaccaaaccctacataaaatcccctaaacaaccaaataatctccgtcccgcctacccgaccgaaatcgcacgaacacaaacgcccacgccatattaactacccaaaaaactcgccgcccaaaccgaaccaaaaaacaaaaaacgaaaaaccaacctccgataacgaacgaaaacaaccgctctttctattctctcttcgccctccctcgtaaaaacgcaaactcgaccctaaacgcttaacccacaaaaatcaacaaattcaaacgaaatattcgcgatcctcgatttctattaattactcaaaaccttttcatacaaccaacaactcgaatatttaataaaatataaatttttctactctaaatttacacacatccgttaccactttcctatccttctcctccctttaaaaacaaaaactcttctaatataaacatatacaaccaccatatatatatccccctaaaacctttatcctctacgcccgaatcaaaaactccgaattttaaaaaatcaaaactaaatttaaataatcgaaactatttacaattcttcccaacgcaaaatccaaaccaacataaatattaaaaatcatttccgaaaaaaccgatctacaaaaaaattaatacttaccctaaacttaaaaatcaacaatcccaaaaactacgcccgccgaaaattcaaacctaaacctcgccgtcaaacgcgctaacgaacctataattcgaacctataattataaactcataaccgaaaaactacactaaacaccttaacgataactccaccactttacaaatttaaaaaaacctaatactaatttaaaaaaaaaaaaatcgctaaatctcgaccctaccgaacattctaactacgataatcttaaatattaccgtattttctaattctcaaaattaattttataaacatttatcctttctttaaaaaaaaacattataataaacattataaaccaatttaataacaaaatatttttactaatattatattaaaatttaaatataaaaacacacccttcaaattctaccaataaaataaaaaaactttatctattacatatcatctacacaataaataccactcaaaattttaaaacttcgaaaaaatatccaaatttcaaattaatccataaacttaataaaatctctatttttatccccaaatttccaattactaatctaaacaaaaacaaaccgtatcataaacaacttaattacttacttaaatatataattccacgcataccacatattttcttaattaaaaaaatataacaatacaccaattactacaaacaccaaataccaaatcaattttattattaaactcctttaaattaatataaaacgctctaccattaaaataaaaacgtttcctaacactaaactaacaccaaaaaatttttactctaaaaaaaccgaatactaaataattaaaaacactaaaaaaattatataaatataaatccccacctcccccgccgccccccccccccgcccccaacacaccaaaaaaccgaaacgcctcgcccgaaaaaaacaacgtaacctaaacctcaactttcgttaacttccttctaccttaaaaaaaaataaaaaattttaacccctaaaatccaaaaattcaaaaactctacgaaattcgaaaaatcttaacgaccccaaacacctaaacgaccgaaaaattaaactttccacctctaccccttctccctcccgacaaactctacgctaaaaactaactttaatcccgccgtctaattcaacaccccctcctacaacccgaccccgcgaacttccacgtccgcctacgaaccatccgaactacgaacccatcctcccgctaataaaaaatacatttcgataaaataaaaacatctaaaaaaaacgcgcacaaaccccacacgcttccccccacgccacccccacaacacactaaaaccccacccataaccgaacataccaccgaacccccacccttccactatcactctaactaacaaaactaaaatccaaaaccctctccgtatccctctcccctccccgctaaacctcgaaatcctctcccgcccgaaaaaaatccgaaaaacgaaaaaaaaaaccgctaccgaaaatcaatcaaatcgttaccctccgtcaatcgcgaactacccgactccctacttctctcgacgacgcccatatccaactcccgaacgaaaaaacgccctcctccaactcctccgcctactcctcctcctcctacacctcctccgcctcctccgccgccgcctccgcctcctccgccgccgcctccgccgaccgcccgaactaccgaactactacgatcgtcgcgacccgcctcgatacaaccgatcgactccttaaccccgcgcaacgacccgctctccaacacctcccgatacgtaatcgcctccttcttctccttcactttctaatcaaaaaacttaaaaacgaacgccgtaaattcttccatcgccgccgcacgtcaacccgacgctcaacctctaccaacaaaaccccgctctttttttccttcttctttttttactactccaacccccccaataataacacatcaataaaacaaaaaataaaaaaaaaaaaaaaaaaaaaaaaaaaaaaaaaaaaaaaaaaaaaaaaaaaaaaaaaaaaaaaaaaaataaaaaaaaaaaaaaaaataaaaaaaaaaaaaaaaaaaaaaaaaaaaaaaaaaaaaaaaaaataaaaaaaaaaaaaaaaaaaaaaaaaaaaaaaaaaaaaacgaaaactaccgaaaaaaaataaaaactaatacttccctaccgaaacgcgcttattcaatattaaaatctttaacaattcttcctacgaaaaattcaaatctaataacgacgctacgcttaaaatcccactatttatacttcctaacgacgacctcttattttaaataaattacctcccctcgcaactcga

SEQ ID NO: 110 - DNA, 10550 bp, Artificial Sequence
  bisulfite converted genomic DNA
tcgagttgcgaggggaggtaatttatttaaaataagaggtcgtcgttaggaagtataaatagtgggattttaagcgtagcgtcgttattagatttgaatttttcgtaggaagaattgttaaagattttaatattgaataagcgcgtttcggtagggaagtattagtttttattttttttcggtagttttcgttttttttttttttttttttttttttttttttttttttatttttttttttttttttttttttttttttttttttttttttttatttttttttttttttttattttttttttttttttttttttttttttttttttttttttttttttttttttttttttttttttttttattttttgttttattgatgtgttattattgggggggttggagtagtaaaaaaagaagaaggaaaaaaagagcggggttttgttggtagaggttgagcgtcgggttgacgtgcggcggcgatggaagaatttacggcgttcgtttttaagttttttgattagaaagtgaaggagaagaaggaggcgattacgtatcgggaggtgttggagagcgggtcgttgcgcggggttaaggagtcgatcggttgtatcgaggcgggtcgcgacgatcgtagtagttcggtagttcgggcggtcggcggaggcggcggcggaggaggcggaggcggcggcggaggaggcggaggaggtgtaggaggaggaggagtaggcggaggagttggaggagggcgttttttcgttcgggagttggatatgggcgtcgtcgagagaagtagggagtcgggtagttcgcgattgacggagggtaacgatttgattgattttcggtagcggttttttttttcgtttttcggatttttttcgggcgggagaggatttcgaggtttagcggggaggggagagggatacggagagggttttggattttagttttgttagttagagtgatagtggaagggtgggggttcggtggtatgttcggttatgggtggggttttagtgtgttgtgggggtggcgtggggggaagcgtgtggggtttgtgcgcgttttttttagatgtttttattttatcgaaatgtattttttattagcgggaggatgggttcgtagttcggatggttcgtaggcggacgtggaagttcgcggggtcgggttgtaggagggggtgttgaattagacggcgggattaaagttagtttttagcgtagagtttgtcgggagggagaaggggtagaggtggaaagtttaatttttcggtcgtttaggtgtttggggtcgttaagatttttcgaatttcgtagagtttttgaatttttggattttaggggttaaaattttttatttttttttaaggtagaaggaagttaacgaaagttgaggtttaggttacgttgtttttttcgggcgaggcgtttcggttttttggtgtgttgggggcggggggggggggcggcgggggaggtggggatttatatttatataatttttttagtgtttttaattatttagtattcggtttttttagagtaaaaattttttggtgttagtttagtgttaggaaacgtttttattttaatggtagagcgttttatattaatttaaaggagtttaataataaaattgatttggtatttggtgtttgtagtaattggtgtattgttatatttttttaattaagaaaatatgtggtatgcgtggaattatatatttaagtaagtaattaagttgtttatgatacggtttgtttttgtttagattagtaattggaaatttggggataaaaatagagattttattaagtttatggattaatttgaaatttggatattttttcgaagttttaaaattttgagtggtatttattgtgtagatgatatgtaatagataaagtttttttattttattggtagaatttgaagggtgtgtttttatatttaaattttaatataatattagtaaaaatattttgttattaaattggtttataatgtttattataatgtttttttttaaagaaaggataaatgtttataaaattaattttgagaattagaaaatacggtaatatttaagattatcgtagttagaatgttcggtagggtcgagatttagcgatttttttttttttaaattagtattaggtttttttaaatttgtaaagtggtggagttatcgttaaggtgtttagtgtagtttttcggttatgagtttataattataggttcgaattataggttcgttagcgcgtttgacggcgaggtttaggtttgaattttcggcgggcgtagtttttgggattgttgatttttaagtttagggtaagtattaatttttttgtagatcggttttttcggaaatgatttttaatatttatgttggtttggattttgcgttgggaagaattgtaaatagtttcgattatttaaatttagttttgattttttaaaattcggagtttttgattcgggcgtagaggataaaggttttagggggatatatatatggtggttgtatatgtttatattagaagagtttttgtttttaaagggaggagaaggataggaaagtggtaacggatgtgtgtaaatttagagtagaaaaatttatattttattaaatattcgagttgttggttgtatgaaaaggttttgagtaattaatagaaatcgaggatcgcgaatatttcgtttgaatttgttgatttttgtgggttaagcgtttagggtcgagtttgcgtttttacgagggagggcgaagagagaatagaaagagcggttgttttcgttcgttatcggaggttggtttttcgttttttgttttttggttcggtttgggcggcgagttttttgggtagttaatatggcgtgggcgtttgtgttcgtgcgatttcggtcgggtaggcgggacggagattatttggttgtttaggggattttatgtagggtttggttcgagtttaggggtagcgaggggcgtttgcggatgcggttttttgtgcggtataatatcggggtttgttgttttcgttgatatttttcggtttaattgtttttaaattagattagtaagtttgcggtaggtagagagttagcggtggtgagagttggtttgagaacgagttagttttttgggaatggtcggtgtgagaggttagtgggtggttttgtcgcgtttttatgtttagattttgttttgtgagaggtttggcgttgcgtttttgatttttgtgagtgttgcggagtaagtgagtgcgaaagtgagtggaaattatttggtgtttgttggggaaggtcggtgattggggggtgaatagtgaggcggtgagtcgaggtacgtttgtgaaggaggtggtggatgattgtttattttgttttaggcggtcgtttagatttgatttttgcgttttttcgggatatttttttttcgggtgggttgagaagtcggattaggattttacgagggggaaggattttttatttttttttgcgataaatttggtaataggatttgttgtgttgttttcgttcgtgtgtgtgtgcgtgtgtgtgtgtgttcgtgtggatgtacgtgtggtttcgttggggtgttttttttagtgttttcggagttgaaagatcgtaaagaggatgcgaaagggatggaggacgaaggttagattaaaattaagtagaggcgaagtcggattaattttattttggaataatttaatgagttggagaggttttttgacgagatttattatttcgacgtttttatgcgagaggaattgagttagcgattgggtttgtcggaggttcgagtgtaggtatttagttgttaggaggtcgagggtttagggagtagagagagtttggggttggaaagaggtttgggggatatattcgggaggtggtgtttttagtgtttggtgtaagatgagaaggaaagagatatttttattagaggttttattttttaaagtagattttagttttatagtatttttttttttttttttttttttattttaatatatgtttttagaagaagaaagttgtgttgggtttttttttagagtttttataaattatattttttttgtttcgtattggttttaatgtggtttaattttaatgggtttatttttataaggtttaaaaaaaaattttatagaaaacgttttatttttggatgttttaaaagttttaaagagtattttgttttttggagttggatttttttgaaagtttgttttgtagggtttaggtttgttaagcggatattttaattaggtttatagatgtgtagattataaagaaaattagtaattgttaagtgtagaaatttatagtttgttgttagcggtcgattttaaattgtgtgtgaaatagcggagaaataaacgtattttggttattttttgtttatttatttaattaaggtaacgaaattgattttaaatatattagattttaaaataaattatatatattagtatttatatttttaaagtttgttttttagtacgtgttatatttaatgaagttaggattgaaatagattttttttattggttgtggaggtaaatgtaatagtaaaaataggttttgggggtatttaaaggagtaaattgtgtatatttatatatatatatttttttagttttagggggaataaatttaaatgttttagattgtattttcgtttagataataaaatagaataaaatgatagttattattggtttgaatatatggagtagttttaggttcgtatatttgtagttgttataaagtatcgttgtaatagatattttttcggtttttgggtatagagattattatttgtagcgaattatgtataatttttaaggggtttttttatattttgtaataggattaggaaaaaaaaaaatagagtagttacgttgaagaggaaaagtaataataggttgttttggttattatagtattagtagtagagtttttttttttaagttttttttgtttcgttttgtgtattgagatttttagaggtttagtaattttttaaaaatatgatgataattattatagttatgattattagtattttaattttaatttttttaggggaaaaaaaggtaagaagttttaggttatgtgaattatataaaggatgttattttggtataaaatttattttttgttgtattaaatagtagagaaatttttgaagatttatattgattatgatatttgtttttaaaaatatattaatgaaagttttgaagtagtatttttattttaatggggttttaaaaattttaatttgtgagttaattaatatgttttattattgaaagtggaatataaaagtaagttttatttgaattttaaaaaatttgttatattgtttgtaaaagttgttaagtttaagtaggtaatatttaggagaataaagtatttaagagttatttgttttatatatattttatttttttttcgttgagtgttttttttttttttttttaagaagtgaattttattgttgttttatatttttatttatattttagttattttttagatgtttttttattattttaattgtaaatagtggttttttttaaagaagtaaattagattattatgataatggtgtataattattttgttattgtgttttattttgttgtatagtagaatagagaaattttaaatttttttgtagtgaggtttttatgatattaattatttttttttaatttttataatttttttttcgtaaaggagttattatttgttttggtgtttggtttttttttaagatgaagttaattaatattataggttattaatgaatatattttttttaggttttaattgggtaaatatttaaattattattatgttggtattaggtattaagtagagttttaggttatggggattttgttatgtgaaaagatgaaattaggattaatagtaatttattttgtgaaagtttataaaatttatttttttatttttgtagttaatttatatgtttaattttggaatttgaggttgttttatataatttaaagattgtttgttgtattttttaatttttgtttaaattacgatttttttttttttgtatttttgtaatttaaaaaaatttttagttataatatttaggttttattttttttttttttttaatttataggtttggttttaaaatcgaagagttaaatgtagaaaataagaaaattaattttataaaggtatgttttttatataaggaatatttgatagtttgagtaaagagagaagtagtgaatattattattataatgatagaaaaaaaggaattttaaaaatgataatagtttttgatttaataatttttaaaggttgttaatggagttttaaagtttgggagtaagttatatttatttaaattttggatgtagtttagaaagataatagtttatttttaaaggaattcgttttgttttgtattttttggaattttgaaaaatgttataaacgttaattttatattattttttttttgtattttttataggtgtttttataggggtcgttagttagtttgaagtttgtagagtcgtattttatgttaacgtaggtgttttaaggatgttattttagtaggtaagtatagtttagttttaagttgtttttaaatatgaaaatatttgaatgtttgtttgaattgttgaatattatttgtttttgagtttagatgttaatgtttgtatagttggagaattattttgagatgatatagtggatttattattttttaaaaatttatacggtattaaaggtttgaatgtttagttttttttgtttttatgggaatttttgaaggggtttgggggtagtaattggttttttaaaaatatattaaagattgtttttagagagagaggaaggaaaagttttttgattaagattttgttaaatttaatatagaggttagttttaaggtatttttaaggtaattttttagatatttttttaggtattttttattttttagttatattaaataattttgatagaagaaaaataaatataagtatttttagtttatatttttgttttttcgtttttttgtttttaaatttgtttttgtaaataaagttttatttttggtaaagagagaagttttggtttttttagggttgttttgtttttgtaattttttagttataaagaaatttttaagagtatattttaaaaggatagtttgtagtaatgatttaattttgggaaattttagtgttttgaattttttattttttaagtttgagggcgaaatttttttttaattagtgtttgattttttttatttttagttaggatttttgtttggtatgtttgtgatgttatgaattagtttttagtttttagtgatttggatcggggagatagataggtgtgattatgaattgagagtcggtgttagggagattttagtttttttggtgttataggattttggtattttgatgtttggttttggaaataagagagaatgattgaagaaagagggaggggtgattttaaaaggagatttttattatttaaaaggtaatttttgggttagtagtaataatatcgtttgggagattgttagaaatttagaattttaggttttaatttagattttgcgaattagaatttgaattttaacgagatttttgggtaattgttatggtaataaaggttagaagtatcgatttataattgtgtttattgtggtgaagatggagtaatttttttgaatgatattaaaaagttgcgtagtttgtttgttgatatttcgttgttttggtagtggggtaagagatgtatggtagtattaagagaagagggtaagggtttttattcgtagtttttttaatatattattttagtttagtttttaggggagacggttatatttttgtagaagggggttttcggggttcggggaaataagtttattttaagcgagtttcggagatttaggggatattggagtatttatgtggaattttagatttagtaataggttgagaaggttattgtcggaataagatgtatagttaaatgtttttttttcgtgtttaaatataatttaattttttttttggttaagttggacgtcgttaatgttttgtttttattttgttgttattttaggatagttattgtaacgtgacgtttttgtttttttaggtttaggcgtagttgtagttggatagcgttgtggcgtacgcgtattattatttgtattcgtatttggtcgcgtacgcgttttatatgatgtttttagtatcgtttttcggattgtcgttcgttacgttggtcgcggattcggttttcgtcgtttcggtagtggcggtcgtagtagtcgttaagattattagtaagaattttagtatcgtcgattttagattgaaagttaaaaagtacgtcgtagttttgggtttgtgacgttaacgttagtattaatgtcgcgtttgtttcgcggtatttagtttgtacgtttttcgcgtttcgttgttttttcgttatttttttgagatttcgggagtcggtttttttttcgttttattgattatttttcgttttttatcgtattttggattcggaaagttagattttacgtaggattagggattttacgaggtacgtaggtttcgtggtttttgttcgtttttttattcgagggtttagaattgggttttgtaggagcgggtttgggggagtttggagagagattggataggggagtgttggaatcgcggagtttggtttatcgtaaagttgtaacgatggatttttgtatagaaaaaaaaattttgttaataatgaaaaaatgagtaaataaaaaaatcgaaagataaacgggagagaaaaagaggaagggaatttattttttaattgttatttggtagaagttgaaattggagaattaaggagtaaaaataaattttaaaattaaagtattttatatatttaaaaatatggaaaaataatttagacgattttcgagagattggggggagttattaatttaaatgtgtgtttttaaaaatgcgttaagaaggtaaagtagaaagaagaggtatatttatttaaaaaattaagatgaaaaaagtgcgtagttgggaagtttataggttttgaaattgatttttttttgcgaagtttacgttaatacgagaaatttgatgagagaggcgggtttttttttacgttgaattagatgttttgagtttaaatttattatgtatggaagagtaagaaaagagaaaatattaaaacgaggagagagaaaaataatattaatataaaaaaatgttatagataatgatttttttgagaaattattatggtaaaattgtttggattgttgatagtaaatttcggtttgtatgttatttgtattttattgatggtgtgtttttttttatttttttattttttatgtatttattttatttttatttttattatgaaaaataatattaaaagtatttggaaattgatatatatatatttatatatatatattatatatttgttatatatatatatatatatatatatatatatatatatatatatttgttttgtttttgattttggggaataaaagaaaaaagttagaaagggaaaaaattatatttattgttttaagaagatagaggtgggtagaatatgtggggaaaggaaaaagaaaataagattattaaatgaaataatgaaggtatagcgtttcgttgtgttagatatagtaggcgtttaattagtattagtttttattatttttttttttttgtgtttttttttgttggttttttgaagttttatttgaagatagtggtttatttttttttttttatttcgttaaatttattttaaataatatttagttagatataggtattaggtttgtgtaagatatgttgatatatacgaataaagtttattttgattataatgtgtggattgatttttaatatttgtattttattttataaaggtgtatttatttaagtaattttttttttttgtttgtttgttttttttttgttttttttttttttttggttgtttgttttaatttatgtagttatttaaattgggatattttggattaagttagtttgtattttaattcgttagtaagtttaagtttgtggggttttgtttttgtttttgttttattttttaatttataagaaagaggaaaagtttttttaattgaattttggtatgcggttgagttttgtaattatttgttttttatgaaaataaaattatttatatttgatatatttttttttagtgtattaagttattttaaataaaagatgttattttatgacgtgttgttagtataaaatgtgtcgtttttaattttgttaaattttttaaataagtgttaagttattaattgaagatattttgcgattaattgaatgaaaatatcgttttatttgatggggttcgagttatttttgtttttgttattattaaaatattcgggatagttttttt

SEQ ID NO: 111 - DNA, 1091 bp, Homo sapiens
acccacccggaggaagaatatcccggagaagcgcaaaggtcaagtctgagcggccgcctggggcaaggtgggcagtcatccaccacctccttcacaaacgtacctcgactcaccgcctcactattcaccccccagtcaccggccttccccagcaaacaccaaatggtttccactcactttcgcactcacttgctccgcagcactcacagaaatcaaaggcgcagcgccaggcctctcacagagcaaagtctggacataagggcgcggcaaggccacccactggcctctcacaccggccattcccagaaggctggctcgttctcaggccagctctcaccaccgctggctctctgcctaccgcaaacttgctggtctaatttaggaacaattgggccgaaaggtatcagcgagagcaacagaccccggtgttgtgccgcacagggagccgcatccgcagacgcccctcgctgcccctgggctcgggccaaaccctgcataaggtcccctggacagccaggtaatctccgtcccgcctgcccgaccggggtcgcacgagcacaggcgcccacgccatgttggctgcccaaagggctcgccgcccaagccgggccagaaggcaggaggcggaaaaccagcctccggtggcgggcgaaagcaaccgctctttctgttctctcttcgccctccctcgtggaaacgcagactcgaccctaaacgcttaacccacagagatcaacaggttcaagcggaatattcgcgatcctcggtttctattggttgctcaaagccttttcatgcaaccagcagctcggatgtttaataaaatatgaatttttctgctctgggtttgcacacatccgttgccactttcctgtccttctcctccctttaaaaacaggagctcttctagtgtgagcatatacagccaccatatatatatccccctggaacctttatcctctgcgcccgaatcagagactccgggttttaagaagtcaaagctgagtttagatagtcgaggctgtttgcagttcttcccagcgcaggatccaggccagcatgggtgttaaaaatcatttccggaagagccg

SEQ ID NO: 112 - DNA, 1091 bp, Artificial Sequence
  bisulfite converted genomic DNA
atttattcggaggaagaatatttcggagaagcgtaaaggttaagtttgagcggtcgtttggggtaaggtgggtagttatttattattttttttataaacgtatttcgatttatcgttttattatttattttttagttatcggttttttttagtaaatattaaatggtttttatttattttcgtatttatttgtttcgtagtatttatagaaattaaaggcgtagcgttaggttttttatagagtaaagtttggatataagggcgcggtaaggttatttattggttttttatatcggttatttttagaaggttggttcgtttttaggttagtttttattatcgttggttttttgtttatcgtaaatttgttggtttaatttaggaataattgggtcgaaaggtattagcgagagtaatagatttcggtgttgtgtcgtatagggagtcgtattcgtagacgtttttcgttgtttttgggttcgggttaaattttgtataaggttttttggatagttaggtaattttcgtttcgtttgttcgatcggggtcgtacgagtataggcgtttacgttatgttggttgtttaaagggttcgtcgtttaagtcgggttagaaggtaggaggcggaaaattagttttcggtggcgggcgaaagtaatcgttttttttgtttttttttcgttttttttcgtggaaacgtagattcgattttaaacgtttaatttatagagattaataggtttaagcggaatattcgcgattttcggtttttattggttgtttaaagtttttttatgtaattagtagttcggatgtttaataaaatatgaatttttttgttttgggtttgtatatattcgttgttatttttttgttttttttttttttttaaaaataggagtttttttagtgtgagtatatatagttattatatatatatttttttggaatttttattttttgcgttcgaattagagatttcgggttttaagaagttaaagttgagtttagatagtcgaggttgtttgtagttttttttagcgtaggatttaggttagtatgggtgttaaaaattattttcggaagagtcg

SEQ ID NO: 113 - DNA, 1091 bp, Artificial Sequence
  bisulfite converted genomic DNA
cgactcttccgaaaataatttttaacacccatactaacctaaatcctacgctaaaaaaaactacaaacaacctcgactatctaaactcaactttaacttcttaaaacccgaaatctctaattcgaacgcaaaaaataaaaattccaaaaaaatatatatataataactatatatactcacactaaaaaaactcctatttttaaaaaaaaaaaaaaaacaaaaaaataacaacgaatatatacaaacccaaaacaaaaaaattcatattttattaaacatccgaactactaattacataaaaaaactttaaacaaccaataaaaaccgaaaatcgcgaatattccgcttaaacctattaatctctataaattaaacgtttaaaatcgaatctacgtttccacgaaaaaaaacgaaaaaaaaacaaaaaaaacgattactttcgcccgccaccgaaaactaattttccgcctcctaccttctaacccgacttaaacgacgaaccctttaaacaaccaacataacgtaaacgcctatactcgtacgaccccgatcgaacaaacgaaacgaaaattacctaactatccaaaaaaccttatacaaaatttaacccgaacccaaaaacaacgaaaaacgtctacgaatacgactccctatacgacacaacaccgaaatctattactctcgctaatacctttcgacccaattattcctaaattaaaccaacaaatttacgataaacaaaaaaccaacgataataaaaactaacctaaaaacgaaccaaccttctaaaaataaccgatataaaaaaccaataaataaccttaccgcgcccttatatccaaactttactctataaaaaacctaacgctacgcctttaatttctataaatactacgaaacaaataaatacgaaaataaataaaaaccatttaatatttactaaaaaaaaccgataactaaaaaataaataataaaacgataaatcgaaatacgtttataaaaaaaataataaataactacccaccttaccccaaacgaccgctcaaacttaacctttacgcttctccgaaatattcttcctccgaataaat

SEQ ID NO: 114 - DNA, 1091 bp, Artificial Sequence
  bisulfite converted genomic DNA
acccacccgaaaaaaaaatatcccgaaaaaacgcaaaaatcaaatctaaacgaccgcctaaaacaaaataaacaatcatccaccacctccttcacaaacgtacctcgactcaccgcctcactattcaccccccaatcaccgaccttccccaacaaacaccaaataatttccactcactttcgcactcacttactccgcaacactcacaaaaatcaaaaacgcaacgccaaacctctcacaaaacaaaatctaaacataaaaacgcgacaaaaccacccactaacctctcacaccgaccattcccaaaaaactaactcgttctcaaaccaactctcaccaccgctaactctctacctaccgcaaacttactaatctaatttaaaaacaattaaaccgaaaaatatcaacgaaaacaacaaaccccgatattataccgcacaaaaaaccgcatccgcaaacgcccctcgctacccctaaactcgaaccaaaccctacataaaatcccctaaacaaccaaataatctccgtcccgcctacccgaccgaaatcgcacgaacacaaacgcccacgccatattaactacccaaaaaactcgccgcccaaaccgaaccaaaaaacaaaaaacgaaaaaccaacctccgataacgaacgaaaacaaccgctctttctattctctcttcgccctccctcgtaaaaacgcaaactcgaccctaaacgcttaacccacaaaaatcaacaaattcaaacgaaatattcgcgatcctcgatttctattaattactcaaaaccttttcatacaaccaacaactcgaatatttaataaaatataaatttttctactctaaatttacacacatccgttaccactttcctatccttctcctccctttaaaaacaaaaactcttctaatataaacatatacaaccaccatatatatatccccctaaaacctttatcctctacgcccgaatcaaaaactccgaattttaaaaaatcaaaactaaatttaaataatcgaaactatttacaattcttcccaacgcaaaatccaaaccaacataaatattaaaaatcatttccgaaaaaaccg

SEQ ID NO: 115 - DNA, 1091 bp, Artificial Sequence
  bisulfite converted genomic DNA
cggttttttcggaaatgatttttaatatttatgttggtttggattttgcgttgggaagaattgtaaatagtttcgattatttaaatttagttttgattttttaaaattcggagtttttgattcgggcgtagaggataaaggttttagggggatatatatatggtggttgtatatgtttatattagaagagtttttgtttttaaagggaggagaaggataggaaagtggtaacggatgtgtgtaaatttagagtagaaaaatttatattttattaaatattcgagttgttggttgtatgaaaaggttttgagtaattaatagaaatcgaggatcgcgaatatttcgtttgaatttgttgatttttgtgggttaagcgtttagggtcgagtttgcgtttttacgagggagggcgaagagagaatagaaagagcggttgttttcgttcgttatcggaggttggtttttcgttttttgttttttggttcggtttgggcggcgagttttttgggtagttaatatggcgtgggcgtttgtgttcgtgcgatttcggtcgggtaggcgggacggagattatttggttgtttaggggattttatgtagggtttggttcgagtttaggggtagcgaggggcgtttgcggatgcggttttttgtgcggtataatatcggggtttgttgttttcgttgatatttttcggtttaattgtttttaaattagattagtaagtttgcggtaggtagagagttagcggtggtgagagttggtttgagaacgagttagttttttgggaatggtcggtgtgagaggttagtgggtggttttgtcgcgtttttatgtttagattttgttttgtgagaggtttggcgttgcgtttttgatttttgtgagtgttgcggagtaagtgagtgcgaaagtgagtggaaattatttggtgtttgttggggaaggtcggtgattggggggtgaatagtgaggcggtgagtcgaggtacgtttgtgaaggaggtggtggatgattgtttattttgttttaggcggtcgtttagatttgatttttgcgttttttcgggatatttttttttcgggtgggt

SEQ ID NO: 116 - DNA, 91 bp, Homo sapiens
gtcccctggacagccaggtaatctccgtcccgcctgcccgaccggggtcgcacgagcacaggcgcccacgccatgttggctgcccaaaggg

SEQ ID NO: 117 - DNA, 91 bp, Artificial Sequence
  bisulfite converted genomic DNA
gttttttggatagttaggtaattttcgtttcgtttgttcgatcggggtcgtacgagtataggcgtttacgttatgttggttgtttaaaggg

SEQ ID NO: 118 - DNA, 91 bp, Artificial Sequence
  bisulfite converted genomic DNA
ccctttaaacaaccaacataacgtaaacgcctatactcgtacgaccccgatcgaacaaacgaaacgaaaattacctaactatccaaaaaac

SEQ ID NO: 119 - DNA, 91 bp, Artificial Sequence
  bisulfite converted genomic DNA
atcccctaaacaaccaaataatctccgtcccgcctacccgaccgaaatcgcacgaacacaaacgcccacgccatattaactacccaaaaaa

SEQ ID NO: 120 - DNA, 91 bp, Artificial Sequence
  bisulfite converted genomic DNA
ttttttgggtagttaatatggcgtgggcgtttgtgttcgtgcgatttcggtcgggtaggcgggacggagattatttggttgtttaggggat

SEQ ID NO: 121 - DNA, 22 bp, Artificial Sequence
  bisulfite converted genomic DNA
gttttttggatagttaggtaat

SEQ ID NO: 122 - DNA, 21 bp, Artificial Sequence
  bisulfite converted genomic DNA
ccctttaaactaccaacataa

SEQ ID NO: 123 - DNA, 32 bp, Artificial Sequence
  bisulfite converted genomic DNA
ggtaatttttgttttgtttgtttgattggggt

SEQ ID NO: 124 - DNA, 33 bp, Artificial Sequence
  bisulfite converted genomic DNA
cataacataaacacctatactcatacaacccca

SEQ ID NO: 125 - DNA, 18 bp, Artificial Sequence
  bisulfite converted genomic DNA
ctcgtacgaccccgatcg

SEQ ID NO: 126 - DNA, 20 bp, Artificial Sequence
  bisulfite converted genomic DNA
ccaaaacctaaacttacaac

SEQ ID NO: 127 - DNA, 19 bp, Artificial Sequence
  bisulfite converted genomic DNA
ggaagatttgggtttggag

SEQ ID NO: 128 - DNA, 31 bp, Artificial Sequence
  bisulfite converted genomic DNA
tacaacaccaccaacaaacccaaaaacacaa

SEQ ID NO: 129 - DNA, 18 bp, Artificial Sequence
  bisulfite converted genomic DNA
cgtttcgtgttttcgggt

SEQ ID NO: 130 - DNA, 19 bp, Artificial Sequence
  bisulfite converted genomic DNA
gggtaggttgaggttttaa

SEQ ID NO: 131 - DNA, 21 bp, Artificial Sequence
  bisulfite converted genomic DNA
acaaaacaataactacaaaac

SEQ ID NO: 132 - DNA, 33 bp, Artificial Sequence
  bisulfite converted genomic DNA
accccaacacaaaaccaactcaaatcatccaca

SEQ ID NO: 133 - DNA, 28 bp, Artificial Sequence
  bisulfite converted genomic DNA
aaaaccccaacacaaaaccaactcaaat

SEQ ID NO: 134 - DNA, 18 bp, Artificial Sequence
  bisulfite converted genomic DNA
cgagttggtttcgcgtcg

SEQ ID NO: 135 - DNA, 22 bp, Artificial Sequence
  bisulfite converted genomic DNA
acctataaataaatccctaaat

SEQ ID NO: 136 - DNA, 19 bp, Artificial Sequence
  bisulfite converted genomic DNA
ttaggaggttttttttgag

SEQ ID NO: 137 - DNA, 31 bp, Artificial Sequence
  bisulfite converted genomic DNA
aaatcaataccacttcacaaatcaacacaac

SEQ ID NO: 138 - DNA, 34 bp, Artificial Sequence
  bisulfite converted genomic DNA
ctaaatcaataccacttcacaaatcaacacaacc

SEQ ID NO: 139 - DNA, 19 bp, Artificial Sequence
  bisulfite converted genomic DNA
cgtgttgattcgcgaagcg

SEQ ID NO: 140 - DNA, 17 bp, Artificial Sequence
  bisulfite converted genomic DNA
ctacctccccaacctta

SEQ ID NO: 141 - DNA, 23 bp, Artificial Sequence
  bisulfite converted genomic DNA
tgagtaagatgattatttggatt

SEQ ID NO: 142 - DNA, 26 bp, Artificial Sequence
  bisulfite converted genomic DNA
ggattttggtgtttgtgatgtggtgg

SEQ ID NO: 143 - DNA, 15 bp, Artificial Sequence
  bisulfite converted genomic DNA
acgccgccgaaactt

SEQ ID NO: 144 - DNA, 24 bp, Artificial Sequence
  bisulfite converted genomic DNA
gttagttattattatgtttatttt

SEQ ID NO: 145 - DNA, 22 bp, Artificial Sequence
  bisulfite converted genomic DNA
aaataatcactaaactattcaa

SEQ ID NO: 146 - DNA, 31 bp, Artificial Sequence
  bisulfite converted genomic DNA
ttcaaccaatcaaaactcaaaaaaacaaaca

SEQ ID NO: 147 - DNA, 21 bp, Artificial Sequence
  bisulfite converted genomic DNA
cgtttttttgagtttcgatcg

SEQ ID NO: 148 - DNA, 19 bp, Artificial Sequence
  bisulfite converted genomic DNA
tttccctctaaatccttaa

SEQ ID NO: 149 - DNA, 20 bp, Artificial Sequence
  bisulfite converted genomic DNA
aatagtgtgggaattttagt

SEQ ID NO: 150 - DNA, 35 bp, Artificial Sequence
  bisulfite converted DNA
aacaataaacatatcacctttaaatcaaaactaaa

SEQ ID NO: 151 - DNA, 18 bp, Artificial Sequence
  bisulfite converted DNA
cgatttaaaggcgatacg

The invention claimed is:

1. A method for detecting hypermethylation of a target DNA in a sample comprising genomic DNA, the method comprising the steps of:
    (a) obtaining a sample comprising genomic DNA;
    (b) converting unmethylated cytosine to another base in the genomic DNA using a converting agent, wherein the genomic DNA is at least partially fragmented;
    (c) amplifying the converted genomic DNA using a pair of methylation non-specific primers comprising the nucleic acid sequences of SEQ ID NOs: 121 and 122 and at least one methylation specific blocker, wherein the methylation specific blocker comprises the nucleic acid sequence of SEQ ID NO: 123 or 124, and wherein the hypermethylated target DNA is a region of genomic human SHOX2 DNA; and
    (d) detecting the amplicon, wherein detecting the amplicon detects hypermethylation of the target DNA in the sample.

2. The method of claim 1, wherein the converting agent converts unmethylated cytosine to uracil.

3. The method of claim 1, wherein the converting agent is a bisulfite.

4. The method of claim 1, wherein the pair of methylation non-specific primers consist of the nucleic acid sequences of SEQ ID NOs: 121 and 122.

5. The method of claim 1, wherein the methylation specific blocker comprises the nucleic acid sequence of SEQ ID NO: 124.

6. The method of claim 1, wherein the amplicon is detected by a method comprising annealing a probe to the amplicon and detecting the annealed probe.

7. The method of claim 6, wherein the probe is linked to a detectable label.

8. The method of claim 6, wherein the probe comprises the nucleic acid sequence of SEQ ID NO: 125.

9. The method of claim 8, wherein the probe consists of the nucleic acid sequence of SEQ ID NO: 125.

10. The method of claim 1, wherein the sample is selected from the group consisting of blood, blood serum, and blood plasma.

11. The method of claim 1, wherein the genomic DNA sequence comprises SEQ ID NO: 116.

12. The method of claim 1, wherein the methylation specific blocker consists of the nucleic acid sequence of SEQ ID NO: 124.

13. The method of claim 1, wherein the methylation specific blocker comprises the nucleic acid sequence of SEQ ID NO: 123.

14. The method of claim 1, wherein the methylation specific blocker consists of the nucleic acid sequence of SEQ ID NO: 123.

* * * * *